US012773452B2

(12) United States Patent
Hofmeister et al.

(10) Patent No.: US 12,773,452 B2
(45) Date of Patent: Oct. 27, 2026

(54) COMPOSITIONS AND METHODS FOR TCR REPROGRAMMING USING CD70 SPECIFIC FUSION PROTEINS

(71) Applicant: TCR2 THERAPEUTICS INC., Cambridge, MA (US)

(72) Inventors: Robert Hofmeister, Scituate, MA (US); Dario Gutierrez, Waltham, MA (US); Andrew Collard, Boston, MA (US); Jason Lajoie, Brighton, MA (US); Vania E. Ashminova, North Billerica, MA (US); Michael Lofgren, Watertown, MA (US); Amy Watt, East Bridgewater, MA (US); Derrick McCarthy, Cambridge, MA (US); Robert Tighe, Cambridge, MA (US)

(73) Assignee: TCR2 THERAPEUTICS INC., Cambridge, MA (US)

( * ) Notice: Subject to any disclaimer, the term of this patent is extended or adjusted under 35 U.S.C. 154(b) by 920 days.

(21) Appl. No.: 17/923,008

(22) PCT Filed: May 5, 2021

(86) PCT No.: PCT/US2021/030973

§ 371 (c)(1),
(2) Date: Nov. 3, 2022

(87) PCT Pub. No.: WO2021/226289

PCT Pub. Date: Nov. 11, 2021

(65) Prior Publication Data

US 2024/0252641 A1 Aug. 1, 2024

Related U.S. Application Data

(60) Provisional application No. 63/171,751, filed on Apr. 7, 2021, provisional application No. 63/147,618, filed on Feb. 9, 2021, provisional application No. 63/129,718, filed on Dec. 23, 2020, provisional application No. 63/020,196, filed on May 5, 2020.

(51) Int. Cl.

| | |
|---|---|
| ***A61K 40/32*** | (2025.01) |
| ***A61K 40/11*** | (2025.01) |
| ***A61K 40/42*** | (2025.01) |
| ***A61P 35/00*** | (2006.01) |
| ***C07K 14/54*** | (2006.01) |
| ***C07K 14/705*** | (2006.01) |
| ***C12N 5/0783*** | (2010.01) |

(52) U.S. Cl.

CPC .............. *A61K 40/32* (2025.01); *A61K 40/11* (2025.01); *A61K 40/4232* (2025.01); *A61P 35/00* (2018.01); *C07K 14/5443* (2013.01); *C07K 14/7051* (2013.01); *C12N 5/0636* (2013.01); *A61K 2239/13* (2023.05); *A61K 2239/21* (2023.05); *A61K 2239/22* (2023.05); *A61K 2239/31* (2023.05); *A61K 2239/38* (2023.05); *A61K 2239/48* (2023.05); *C07K 2317/565* (2013.01); *C07K 2317/569* (2013.01); *C07K 2317/622* (2013.01); *C12N 2510/00* (2013.01)

(58) Field of Classification Search

CPC ..................................................... A61K 40/32

See application file for complete search history.

(56) References Cited

U.S. PATENT DOCUMENTS

| | | | |
|---|---|---|---|
| 4,816,567 | A | 3/1989 | Cabilly et al. |
| 5,199,942 | A | 4/1993 | Gillis |
| 5,225,539 | A | 7/1993 | Winter |
| 5,350,674 | A | 9/1994 | Boenisch et al. |
| 5,399,346 | A | 3/1995 | Anderson et al. |
| 5,530,101 | A | 6/1996 | Queen et al. |
| 5,565,332 | A | 10/1996 | Hoogenboom et al. |
| 5,580,859 | A | 12/1996 | Felgner et al. |
| 5,585,089 | A | 12/1996 | Queen et al. |
| 5,585,362 | A | 12/1996 | Wilson et al. |
| 5,589,466 | A | 12/1996 | Felgner et al. |
| 5,766,886 | A | 6/1998 | Studnicka et al. |
| 5,858,358 | A | 1/1999 | June et al. |
| 5,883,223 | A | 3/1999 | Gray |
| 5,912,172 | A | 6/1999 | Eshhar et al. |
| 6,120,766 | A | 9/2000 | Hale et al. |
| 6,326,193 | B1 | 12/2001 | Liu et al. |
| 6,331,415 | B1 | 12/2001 | Cabilly et al. |
| 6,352,694 | B1 | 3/2002 | June et al. |

(Continued)

FOREIGN PATENT DOCUMENTS

| | | | |
|---|---|---|---|
| CN | 102209728 | A | 10/2011 |
| CN | 104136458 | A | 11/2014 |

(Continued)

OTHER PUBLICATIONS

"IL-15Ra amino acid sequence". Retrieved on Jan. 6, 2026 from Uniprot website https://www.uniprot.org/uniprotkb/Q13261/entry). (Year: 2026).*

Barrett et al. Eradication of established CD19-positive leukemia using a single injection of chimeric immunoreceptor modified lentiviral-transduced T cells in a xenograft NOG mouse model. Presentation (20 pgs) (Retrieved 2019).

Ding et al. Mesothelin-targeting T cells bearing a novel T cell receptor fusion construct (TRUC) exhibit potent antitumor efficacy against solid tumors. Oncoimmunology 12(1):2182058 (2023).

Zhang et al., New High Affinity Monoclonal Antibodies Recognize Non-Overlapping Epitopes on Mesothelin for Monitoring and Treating Mesothelioma. Sci Rep 5:9928 (2015).

Sauer, Tim et al. CD70-specific CAR T cells have potent activity against acute myeloid leukemia without HSC toxicity. Blood 138(4):318-330 (2021).

(Continued)

*Primary Examiner* — Christopher M Babic

*Assistant Examiner* — Hanan Isam Abuzeineh

(74) *Attorney, Agent, or Firm* — WILSON SONSINI GOODRICH & ROSATI

(57) ABSTRACT

Provided herein are T cell receptor (TCR) fusion proteins (TFPs) comprising CD70 binding domains, T cells engineered to express one or more TFPs, antibodies that specifically bind CD70, and methods of use thereof for the treatment of diseases, including cancer.

40 Claims, 148 Drawing Sheets

Specification includes a Sequence Listing.

(56) References Cited

U.S. PATENT DOCUMENTS

| | | | |
|---|---|---|---|
| 6,407,213 | B1 | 6/2002 | Carter et al. |
| 6,534,055 | B1 | 3/2003 | June et al. |
| 6,548,640 | B1 | 4/2003 | Winter |
| 6,692,964 | B1 | 2/2004 | June et al. |
| 6,797,514 | B2 | 9/2004 | Berenson et al. |
| 6,867,041 | B2 | 3/2005 | Berenson et al. |
| 6,887,466 | B2 | 5/2005 | June et al. |
| 6,905,680 | B2 | 6/2005 | June et al. |
| 6,905,681 | B1 | 6/2005 | June et al. |
| 6,905,874 | B2 | 6/2005 | Berenson et al. |
| 7,067,318 | B2 | 6/2006 | June et al. |
| 7,144,575 | B2 | 12/2006 | June et al. |
| 7,172,869 | B2 | 2/2007 | June et al. |
| 7,175,843 | B2 | 2/2007 | June et al. |
| 7,232,566 | B2 | 6/2007 | June et al. |
| 7,371,849 | B2 | 5/2008 | Honda et al. |
| 7,572,631 | B2 | 8/2009 | Berenson et al. |
| 7,695,936 | B2 | 4/2010 | Carter et al. |
| 7,741,465 | B1 | 6/2010 | Eshhar et al. |
| 8,389,282 | B2 | 3/2013 | Sadelain et al. |
| 8,679,492 | B2 | 3/2014 | Blein et al. |
| 8,697,359 | B1 | 4/2014 | Zhang |
| 9,062,127 | B2 | 6/2015 | Voss et al. |
| 9,102,736 | B2 | 8/2015 | Hofmeister et al. |
| 9,181,527 | B2 | 11/2015 | Sentman |
| 9,220,728 | B2 | 12/2015 | Sadelain et al. |
| 9,365,641 | B2 | 6/2016 | June et al. |
| 9,393,257 | B2 | 7/2016 | Osborn et al. |
| 9,422,351 | B2 | 8/2016 | Scholler et al. |
| 9,447,194 | B2 | 9/2016 | Jensen |
| 9,464,140 | B2 | 10/2016 | June et al. |
| 9,688,740 | B2 | 6/2017 | Choi et al. |
| 10,093,900 | B2 | 10/2018 | Jantz et al. |
| 10,208,285 | B2 | 2/2019 | Baeuerle et al. |
| 10,358,473 | B2 | 7/2019 | Baeuerle et al. |
| 10,358,474 | B2 | 7/2019 | Baeuerle et al. |
| 10,442,849 | B2 | 10/2019 | Baeuerle et al. |
| 11,028,142 | B2 | 6/2021 | Baeuerle et al. |
| 11,377,638 | B2 | 7/2022 | Baeuerle et al. |
| 2004/0266390 | A1 | 12/2004 | Faucher et al. |
| 2005/0042664 | A1 | 2/2005 | Wu et al. |
| 2005/0048617 | A1 | 3/2005 | Wu et al. |
| 2005/0100543 | A1 | 5/2005 | Hansen et al. |
| 2005/0175606 | A1 | 8/2005 | Huang et al. |
| 2006/0121005 | A1 | 6/2006 | Berenson et al. |
| 2007/0014794 | A1 | 1/2007 | Carter et al. |
| 2008/0294058 | A1 | 11/2008 | Shklarski |
| 2009/0322513 | A1 | 12/2009 | Hwang et al. |
| 2011/0189141 | A1 | 8/2011 | Kieback et al. |
| 2013/0066283 | A1 | 3/2013 | Alster et al. |
| 2013/0266551 | A1 | 10/2013 | Campana et al. |
| 2013/0280220 | A1 | 10/2013 | Ahmed et al. |
| 2013/0315884 | A1 | 11/2013 | Galetto et al. |
| 2013/0323214 | A1 | 12/2013 | Gottschalk et al. |
| 2013/0323247 | A1 | 12/2013 | Zugmaier et al. |
| 2014/0004132 | A1 | 1/2014 | Brenner et al. |
| 2014/0050708 | A1 | 2/2014 | Powell et al. |
| 2014/0099340 | A1 | 4/2014 | June et al. |
| 2014/0227237 | A1 | 8/2014 | June et al. |
| 2014/0271635 | A1 | 9/2014 | Brogdon et al. |
| 2014/0286973 | A1 | 9/2014 | Powell, Jr. |
| 2014/0301993 | A1 | 10/2014 | Powell, Jr. et al. |
| 2014/0308250 | A1 | 10/2014 | Handgretinger et al. |
| 2014/0308259 | A1 | 10/2014 | Scholler et al. |
| 2014/0322212 | A1 | 10/2014 | Brogdon et al. |
| 2014/0322216 | A1 | 10/2014 | Kaplan |
| 2014/0370045 | A1 | 12/2014 | June et al. |
| 2015/0031624 | A1 | 1/2015 | Feldman et al. |
| 2015/0051266 | A1 | 2/2015 | Kochenderfer |
| 2015/0093822 | A1 | 4/2015 | June et al. |
| 2015/0190428 | A1 | 7/2015 | June et al. |
| 2015/0203817 | A1 | 7/2015 | Galetto et al. |
| 2015/0238631 | A1 | 8/2015 | Kim et al. |
| 2015/0252110 | A1 | 9/2015 | Hansen et al. |
| 2015/0284475 | A1 | 10/2015 | Zhou et al. |
| 2015/0297640 | A1 | 10/2015 | Cooper et al. |
| 2015/0306141 | A1 | 10/2015 | Jensen et al. |
| 2015/0307564 | A1 | 10/2015 | Young et al. |
| 2015/0322169 | A1 | 11/2015 | June et al. |
| 2015/0329640 | A1 | 11/2015 | Finer |
| 2015/0342993 | A1 | 12/2015 | Kloss et al. |
| 2015/0344573 | A1 | 12/2015 | Chang et al. |
| 2015/0344844 | A1 | 12/2015 | Better et al. |
| 2015/0368360 | A1 | 12/2015 | Liang et al. |
| 2015/0376287 | A1 | 12/2015 | Vu et al. |
| 2015/0376296 | A1 | 12/2015 | Fedorov et al. |
| 2016/0008398 | A1 | 1/2016 | Sadelain et al. |
| 2016/0009813 | A1 | 1/2016 | Themeli et al. |
| 2016/0015749 | A1 | 1/2016 | Gottschalk et al. |
| 2016/0030479 | A1 | 2/2016 | Abbot et al. |
| 2016/0039903 | A1 | 2/2016 | Ring et al. |
| 2016/0040127 | A1 | 2/2016 | Leventhal et al. |
| 2016/0045551 | A1 | 2/2016 | Brentjens et al. |
| 2016/0046678 | A1 | 2/2016 | Roschke et al. |
| 2016/0046724 | A1 | 2/2016 | Brogdon et al. |
| 2016/0052990 | A1 | 2/2016 | Ring et al. |
| 2016/0120906 | A1 | 5/2016 | Galetto et al. |
| 2016/0122782 | A1 | 5/2016 | Crisman et al. |
| 2016/0144026 | A1 | 5/2016 | Lutteropp et al. |
| 2016/0145354 | A1 | 5/2016 | Bacac et al. |
| 2016/0158359 | A1 | 6/2016 | Gilbert |
| 2016/0176973 | A1 | 6/2016 | Kufer et al. |
| 2016/0184362 | A1 | 6/2016 | Duchateau et al. |
| 2016/0185861 | A1 | 6/2016 | Bedoya et al. |
| 2016/0185862 | A1 | 6/2016 | Wu et al. |
| 2016/0186165 | A1 | 6/2016 | Dose et al. |
| 2016/0194375 | A1 | 7/2016 | Kitchen et al. |
| 2016/0206656 | A1 | 7/2016 | Gilbert |
| 2016/0207989 | A1 | 7/2016 | Short |
| 2016/0215051 | A1 | 7/2016 | Sharma et al. |
| 2016/0228547 | A1 | 8/2016 | Wagner et al. |
| 2016/0235787 | A1 | 8/2016 | June et al. |
| 2016/0237139 | A1 | 8/2016 | Puléet al. |
| 2016/0237407 | A1 | 8/2016 | Wagner et al. |
| 2016/0256488 | A1 | 9/2016 | Wu |
| 2016/0257762 | A1 | 9/2016 | Kwon et al. |
| 2016/0264665 | A1 | 9/2016 | Lim et al. |
| 2016/0272999 | A1 | 9/2016 | Duchateau et al. |
| 2016/0289343 | A1 | 10/2016 | Wu |
| 2016/0296633 | A1 | 10/2016 | Goldenberg et al. |
| 2016/0340406 | A1 | 11/2016 | Zhao et al. |
| 2017/0174774 | A1 | 6/2017 | Coric et al. |
| 2018/0127502 | A1 | 5/2018 | Brentjens et al. |
| 2018/0185434 | A1 | 7/2018 | Borrello et al. |
| 2018/0273601 | A1 | 9/2018 | Adusumilli et al. |
| 2018/0318349 | A1 | 11/2018 | Thompson |
| 2018/0327470 | A1 | 11/2018 | Li et al. |
| 2018/0360884 | A1 | 12/2018 | Adusumilli |
| 2019/0010207 | A1 | 1/2019 | Kobold et al. |
| 2019/0106478 | A1 | 4/2019 | Noessner et al. |
| 2019/0209612 | A1 | 7/2019 | Pulé et al. |
| 2019/0233528 | A1* | 8/2019 | Srivatsa Srinivasan .................... C07K 16/2875 |
| 2019/0248865 | A1 | 8/2019 | Lu et al. |
| 2019/0255108 | A1* | 8/2019 | Ma .................... A61K 40/4211 |
| 2019/0276540 | A1* | 9/2019 | Baeuerle .......... C07K 14/70535 |
| 2019/0330306 | A1 | 10/2019 | Noonan et al. |
| 2019/0359726 | A1 | 11/2019 | Wang et al. |
| 2020/0207828 | A1 | 7/2020 | Baeuerle et al. |
| 2020/0392459 | A1 | 12/2020 | Cathomen et al. |
| 2021/0187022 | A1 | 6/2021 | Getts et al. |
| 2022/0362295 | A1 | 11/2022 | Kieffer-Kwon et al. |
| 2023/0235010 | A1 | 7/2023 | Baeuerle et al. |
| 2024/0301026 | A1 | 9/2024 | Baeuerle et al. |

FOREIGN PATENT DOCUMENTS

| | | | |
|---|---|---|---|
| EP | 0239400 | A2 | 9/1987 |
| EP | 0519596 | A1 | 12/1992 |
| EP | 0592106 | A1 | 4/1994 |
| EP | 0239400 | B1 | 8/1994 |
| EP | 0592106 | B1 | 11/2004 |
| EP | 0519596 | B1 | 2/2005 |
| EP | 1075517 | B1 | 7/2006 |

(56) References Cited

FOREIGN PATENT DOCUMENTS

| | | | |
|---|---|---|---|
| EP | 2258720 | A1 | 12/2010 |
| EP | 2894164 | A1 | 7/2015 |
| EP | 2342227 | B1 | 10/2015 |
| EP | 2632954 | B1 | 11/2015 |
| EP | 2982692 | A1 | 2/2016 |
| EP | 2982696 | A2 | 2/2016 |
| EP | 2361936 | B1 | 4/2016 |
| EP | 3006459 | A1 | 4/2016 |
| EP | 3018145 | A1 | 5/2016 |
| EP | 3019622 | A2 | 5/2016 |
| EP | 3023437 | A1 | 5/2016 |
| EP | 2686417 | B1 | 6/2016 |
| EP | 2982694 | B1 | 6/2016 |
| EP | 3025719 | A1 | 6/2016 |
| EP | 3029067 | A1 | 6/2016 |
| EP | 3029068 | A1 | 6/2016 |
| EP | 2370467 | B1 | 9/2016 |
| JP | H07505282 | A | 6/1995 |
| JP | 2004529636 | A | 9/2004 |
| JP | 2007536905 | A | 12/2007 |
| JP | 2012508164 | A | 4/2012 |
| JP | 2014532642 | A | 12/2014 |
| JP | 2014534242 | A | 12/2014 |
| KR | 20090092900 | A | 9/2009 |
| TW | 201833326 | A | 9/2018 |
| WO | WO-9109967 | A1 | 7/1991 |
| WO | WO-9317105 | A1 | 9/1993 |
| WO | WO-9319163 | A1 | 9/1993 |
| WO | WO-0077029 | A1 | 12/2000 |
| WO | WO-0129058 | A1 | 4/2001 |
| WO | WO-0196584 | A2 | 12/2001 |
| WO | WO-02077029 | A2 | 10/2002 |
| WO | WO-2005052006 | A2 | 6/2005 |
| WO | WO-2006020258 | A2 | 2/2006 |
| WO | WO-2007024715 | A2 | 3/2007 |
| WO | WO-2010029434 | A1 | 3/2010 |
| WO | WO-2010052014 | A1 | 5/2010 |
| WO | WO-2010104949 | A2 | 9/2010 |
| WO | WO-2012058460 | A2 | 5/2012 |
| WO | WO-2012079000 | A1 | 6/2012 |
| WO | WO-2012138475 | A1 | 10/2012 |
| WO | WO-2013072406 | A1 | 5/2013 |
| WO | WO-2013072415 | A1 | 5/2013 |
| WO | WO-2013126712 | A1 | 8/2013 |
| WO | WO-2013126729 | A1 | 8/2013 |
| WO | WO-2013154760 | A1 | 10/2013 |
| WO | WO-2013176916 | A1 | 11/2013 |
| WO | WO-2014031687 | A1 | 2/2014 |
| WO | WO-2014052064 | A1 | 4/2014 |
| WO | WO-2014055657 | A1 | 4/2014 |
| WO | WO-2014122143 | A1 | 8/2014 |
| WO | WO-2014122144 | A1 | 8/2014 |
| WO | WO-2014140248 | A1 | 9/2014 |
| WO | WO-2014153270 | A1 | 9/2014 |
| WO | WO-2014184143 | A1 | 11/2014 |
| WO | WO-2014190273 | A1 | 11/2014 |
| WO | WO-2015006749 | A2 | 1/2015 |
| WO | WO-2015057834 | A1 | 4/2015 |
| WO | WO-2015057852 | A1 | 4/2015 |
| WO | WO-2015090229 | A1 | 6/2015 |
| WO | WO-2015092024 | A2 | 6/2015 |
| WO | WO-2015095895 | A1 | 6/2015 |
| WO | WO-2015112800 | A1 | 7/2015 |
| WO | WO-2015112830 | A1 | 7/2015 |
| WO | WO-2015121454 | A1 | 8/2015 |
| WO | WO-2015123642 | A1 | 8/2015 |
| WO | WO-2015124715 | A1 | 8/2015 |
| WO | WO-2015142661 | A1 | 9/2015 |
| WO | WO-2015142675 | A2 | 9/2015 |
| WO | WO-2015164745 | A1 | 10/2015 |
| WO | WO-2015168613 | A2 | 11/2015 |
| WO | WO-2015179801 | A1 | 11/2015 |
| WO | WO-2016011210 | A2 | 1/2016 |
| WO | WO-2016014789 | A2 | 1/2016 |
| WO | WO-2016019969 | A1 | 2/2016 |
| WO | WO-2016025454 | A2 | 2/2016 |
| WO | WO-2016030691 | A1 | 3/2016 |
| WO | WO-2016036678 | A1 | 3/2016 |
| WO | WO-2016040441 | A1 | 3/2016 |
| WO | WO-2016044853 | A1 | 3/2016 |
| WO | WO-2016054520 | A2 | 4/2016 |
| WO | WO-2016055551 | A1 | 4/2016 |
| WO | WO-2016070061 | A1 | 5/2016 |
| WO | WO-2016073381 | A1 | 5/2016 |
| WO | WO-2016079081 | A1 | 5/2016 |
| WO | WO-2016081518 | A2 | 5/2016 |
| WO | WO-2016087245 | A1 | 6/2016 |
| WO | WO-2016090034 | A2 | 6/2016 |
| WO | WO-2016090312 | A1 | 6/2016 |
| WO | WO-2016090320 | A1 | 6/2016 |
| WO | WO-2016090327 | A2 | 6/2016 |
| WO | WO-2016097231 | A2 | 6/2016 |
| WO | WO-2016115274 | A1 | 7/2016 |
| WO | WO-2016115482 | A1 | 7/2016 |
| WO | WO-2016116601 | A1 | 7/2016 |
| WO | WO-2016123675 | A1 | 8/2016 |
| WO | WO-2016126608 | A1 | 8/2016 |
| WO | WO-2016127043 | A1 | 8/2016 |
| WO | WO-2016127257 | A1 | 8/2016 |
| WO | WO-2016132366 | A1 | 8/2016 |
| WO | WO-2016141357 | A1 | 9/2016 |
| WO | WO-2016151315 | A1 | 9/2016 |
| WO | WO-2016161415 | A2 | 10/2016 |
| WO | WO-2016187349 | A1 | 11/2016 |
| WO | WO-2016203048 | A1 | 12/2016 |
| WO | WO-2017091546 | A1 | 6/2017 |
| WO | WO-2018044866 | A1 | 3/2018 |
| WO | WO-2018067993 | A1 | 4/2018 |
| WO | WO-2018098365 | A2 | 5/2018 |
| WO | WO-2018119298 | A1 | 6/2018 |
| WO | WO-2018152181 | A1 | 8/2018 |
| WO | WO-2019067805 | A1 | 4/2019 |
| WO | WO-2019141732 | A1 | 7/2019 |
| WO | WO-2019173693 | A1 | 9/2019 |
| WO | WO-2020043152 | A1 | 3/2020 |
| WO | WO-2020060593 | A1 | 3/2020 |
| WO | WO-2021133959 | A2 | 7/2021 |
| WO | WO-2021142302 | A1 | 7/2021 |
| WO | WO-2021226289 | A2 | 11/2021 |
| WO | WO-2022006451 | A2 | 1/2022 |
| WO | WO-2022020720 | A1 | 1/2022 |
| WO | WO-2022037520 | A1 | 2/2022 |
| WO | WO-2022140665 | A1 | 6/2022 |
| WO | WO-2022150831 | A1 | 7/2022 |
| WO | WO-2022177966 | A1 | 8/2022 |
| WO | WO-2022192286 | A1 | 9/2022 |
| WO | WO-2022232277 | A1 | 11/2022 |
| WO | WO-2023086379 | A2 | 5/2023 |
| WO | WO-2023235479 | A1 | 12/2023 |

OTHER PUBLICATIONS

Abate-Daga et al. CAR models: next-generation CAR modifications for enhanced T-cell function. Mol Ther Oncolytics 3:16014 (2016).
Acuto et al. Tailoring T-cell receptor signals by proximal negative feedback mechanisms. Nat Rev Immunol 8(9):699-712 (2008).
Adams et al., Big Opportunities for small molecules in immuno-oncology. Nature Reviews 14:614-622 (2015).
Adli. The CRISPR tool kit for genome editing and beyond. Nat. Commun. 9:1911 (2018).
Adomako, et al., Identification of markers that functionally define a quiescent multiple myeloma cell sub-population surviving bortezomib treatment. BMC Cancer 15:44 (2015).
Adusumilli et al. 342: A Phase 1 Clinical Trial of Malignant Pleural Disease Treated with Regionally Delivered Autologous Mesothelin-Targeted CAR T Cells: Safety and Efficacy—A Preliminary Report. Mol Therapy 26(5S1):158-159 (2018).
Adusumilli et al. Regional delivery of mesothelin-targeted CAR T cell therapy generates potent and long-lasting CD4-dependent tumor immunity. Sci Transl Med 6(261):261ra151 (2014) (w/Supplementary Data).
Agata et al. Expression of the PD-1 antigen on the surface of stimulated mouse T and B lymphocytes. Int Immunol 8:765-775 (1996).

(56) References Cited

OTHER PUBLICATIONS

Ager et al. Homing to solid cancers: a vascular checkpoint in adoptive cell therapy using CAR T-cells. Biochemical Society transactions. 44(2):377-385 (2016).
Almasbak et al. CAR T Cell Therapy: A Game Changer in Cancer Treatment. Journal of Immunology Research. 2016:1-10 (2016).
Al-Rawi et al. Interleukin-7 (IL-7) and IL-7 receptor (IL-7R) signalling complex in human solid tumours. Hist Histopathol 18:911-923 (2003).
Altenschmidt et al., Cytolysis of Tumor Cells Expressing the Neu/erbB-2, erbB-3, and erbB-4 Receptors by Genetically Targeted Naïve T Lymphocytes. Clinical Cancer Research 2:1001-1008 (1996).
Altschul et al. Basic local alignment search tool. J Mol Biol 215(3):403-410 (1990).
Altschul, et al. Gapped BLAST and PSI-BLAST: a new generation of protein database search programs. Nucleic Acids Res 25:3389-3402 (1997).
An, et al., Construction of a new anti-CD19 chimeric antigen receptor and the anti-leukemia function study of the transduced T cells. Oncotarget 7(9):10638-10649 (2016).
Andersen, et al., Lag-3, Tim-3, and TIGIT: Co-inhibitory Receptors with Specialized Functions in Immune Regulations. Immunity 44:989-1004 (2016).
Angelo et al. Antitumor Activity Associated with Prolonged Persistence of Adoptively Transferred NY-ESO-1c259 T cells in Synovial Sarcoma. Cancer Disov 8(8):944-957 (2018).
Ankri et al. Human T cells engineered to express a programmed death 1/28 costimulatory retargeting molecule display enhanced antitumor activity. J Immunol 191:4121-4129 (2013).
Arasanz et al. PD1 signal transduction pathways in T cells. Oncotarget 8:51936-51945 (2017).
Ausubel, et al., Production of CGMP-Grade Lentiviral Vectors BioProcess International 10(2):32-48 (2012).
Azuma et al. B70 antigen is a second ligand for CTLA-4 and CD28. Nature 366:76-79 (1993).
Baca et al. Antibody humanization using monovalent phage display. J Biol Chem 272(16):10678-10684 (1997).
Baeuerle et al. A Novel T Cell Therapy Engaging the Complete T Cell Receptor. (45 pgs) (2016).
Baeuerle et al. Synthetic TRuC receptors engaging the complete T cell Receptor for potent anti-tumor response. Nat Commun 10:2087 (2019).
Baitsch, et al., Exhaustion of tumor-specific CD8+ T cells in metastases from melanoma patients. J Clin Invest 121(6):2350-2360 (2011).
Barretina et al. The Cancer Cell Line Encyclopedia enables predictive modelling of anticancer drug sensitivity. Nature 483:603-607 (2012).
Barrett et al. Circular RNAs: analysis, expression and potential functions. Development 143:1838-1847 (2016).
Barrett et al. Eradication of established CD19-positive leukemia using a single injection of chimeric immunoreceptor modified lentiviral-transduced T cells in a xenograft NOG mouse model. Journal of Immunotherapy 32(9):941 (2009).
Barrett et al. Treatment of advanced leukemia in mice with mRNA engineered T cells. Hum Gene Ther 22:1575-1586 (2011).
Batlevi et al. Novel immunotherapies in lymphoid malignancies. Nat Rev Clin Oncol 13(1):25-40 (2016).
Batzer et al. Enhanced evolutionary PCR using oligonucleotides with inosine at the 3'-terminus. Nucleic Acid Res 19:5081 (1991).
Beatty et al. Activity of Mesothelin-specific Chimeric Antigen Receptor T cells Against Pancreatic Carcinoma Metastases in a Phase 1 Trial. Gastroenterology 5085(18)30323-30328 (accepted manuscript) (2018).
Beatty, et al., Chimeric antigen receptor-modified T cells for the treatment of solid tumors: Defining the challenges and next steps. Pharmacology & Therapeutics 166:30-39 (2016).
Beatty et al. Mesothelin-Specific Chimeric Antigen Receptor mRNA-Engineered T Cells Induce Antitumor Activity in Solid Malignancies. Cancer Immunol 3(2):217 (2015).
Beatty et al. Mesothelin-specific Chimeric Antigen Receptor mRNA-Engineered T cells Induce Anti-Tumor Activity in Solid Malignancies. Cancer Immunol Res 2(2):112-120 (2014).
Bejarano et al.: Motif trap:A rapid method to clone motifs that can target proteins to defined subcellular localisations. J Cell Sci. 112( Pt 23):4207-4211 (1999).
Better, et al., Manufacturing and Characterization of KTE-C19 in a Multicenter trial of Subjects with Refractory Aggressive Non-Hodgkin Lymphoma (NHL) (ZUMA-1) AACR Poster (Abstract 2308) (2016).
Bettini, et al., Cutting Edge: CD3 ITAM Diversity Is Required for Optimal TCR Signaling and Thymocyte Development. J Immunol 199:1555-1560 (2017).
Beurdeley et al. Compact designer TALENs for efficient genome engineering. Nat Commun 4:1762 (2013).
Bezverbnaya et al. Tumor-targeting domains for chimeric antigen receptor T cells. Immunotherapy 9(1):33-46 (2017).
Billadeau et al. ITAMs versus ITIMs: striking a balance during cell regulation. J Clin Invest 109:161-168 (2002).
Bird et al. Single-chain antigen-binding proteins. Science 242(4877):423-426 (1988).
Blank et al. Interaction of PD-L1 on tumor cells with PD-1 on tumor-specific T cells as a mechanism of immune evasion: implications for tumor immunotherapy. Cancer Immunol Immunother 54:307-314 (2005).
Bonifant et al. Toxicity and management in CAR T-cell Therapy. Mol Ther Oncolytics 3:16011 (2016).
Borroto et al. Crammed signaling motifs in the T-cell receptor. Immunol Lett 161:113-117 (2014).
Brahmer et al. Safety and activity of anti-PD-L1 antibody in patients with advanced cancer. N Engl J Med 366(26):2455-2465 (2012).
Brentjens et al. Genetically targeted T cells eradicate systemic acute lymphoblastic leukemia xenograft. Clin Cancer Res13:5426-5435 (2007).
Brentjens. Novel cellular therapies for leukemia: CAR-modified T cells targeted to the CD19 antigen. Hematology Am Soc Hematol Educ Program 2012:143-151 (2012).
Bridgeman et al. Building better chimeric antigen receptors for adoptive T cell therapy. Current Gene Therapy 10:77-90 (2010).
Bridgeman et al. Structural and biophysical determinants of αβ T-cell antigen recognition. Immunology 135(1):9-18 (2012).
Brocker et al. Redirecting the complete T cell receptor/CD3 signaling machinery towards native antigen via modified T cell receptor. Eur J. Immunol 26:1770-1774 (1996).
Brocker et al. Signals through T cell receptor-zeta chain alone are insufficient to prime resting T lymphocytes. J Med Chem 181:1653-1659 (1995).
Brocker. Chimeric Fv-zeta or Fv-epsilon receptors are not sufficient to induce activation or cytokine production in peripheral T cells. Blood 96(5):1999-2001 (2000).
Brudno et al. Allogeneic T cells that express an anti-CD19 chimeric antigen receptor induce remissions of B-cell malignancies that progress after allogeneic hematopoietic stem-cell transplantation without causing graft-versus-host disease. J Clin Oncol 34(10):1112-1121 (2016).
Buck et al. Mitochondrial Dynamics Controls T Cell Fate through Metabolic Programming. Cell 166:63-76 (2016).
Budde et al. Combining a CD20 chimeric antigen receptor and an inducible caspase 9 suicide switch to improve the efficacy and safety of T cell adoptive immunotherapy for lymphoma. PLoS One 8(12):e82742 (2013).
Budhu, et al., The importance of animal models in tumor immunity and immunotherapy. Curr Opin Genet Dev. 24:46-51 (2014).
Caldas et al. Design and synthesis of germline-based hemi-humanized single-chain Fv against the CD18 surface antigen. Protein Eng 13(5):353-360 (2000).
Call et al. The organizing principle in the formation of the T cell receptor-CD3 complex. Cell 111(7):967-979 (2002).
Carpenito et al. Control of large, established tumor xenografts with genetically retargeted human T cells containing CD28 and CD137 domains. PNAS USA 106(9):3360-3365 (2009).

(56) References Cited

OTHER PUBLICATIONS

Carpenter et al. B-cell maturation antigen is a promising target for adoptive T-cell therapy of multiple myeloma. Clin Cancer Res 19(8):2048-2060 (2013).
Cartellieri et al. Switching CAR T cells on and off: a novel modular platform for retargeting of T cells to AML blasts. Blood Cancer J 6(8):e458 (2016).
Carter et al. Humanization of an anti-p185HER2 antibody for human cancer therapy. PNAS USA 89(10):4285-4289 (1992).
Carter et al. PD-1: Pd-L inhibitory pathway affects both CD4(+) and CD8(+) T cells and is overcome by IL-2. Eur J Immunol 32:634-643 (2002).
Cavalieri, et al., Human T lymphocytes transduced by lentiviral vectors in the absence of TCR activation maintain an intact immune competence. Blood 102(2):497-505 (2003).
Chan et al. Chimeric antigen receptor-redirected CD45RA-negative T cells have potent antileukemia and pathogen memory response without graft-versus-host activity. Leukemia 29:387-395 (2015).
Chandran et al. T cell receptor-based cancer immunotherapy: Emerging efficacy and pathways of resistance. Immunol Rev 290(1):127-147 (2019).
Chandry et al. Activation of a cryptic 5' splice site in the upstream exon of the phage T4 td transcript: exon context, missplicing, and mRNA deletion in a fidelity mutant. Genes Dev 1(9):1028-1037 (1987).
Chang et al. Characterization of the antigen (CAK1) recognized by monoclonal antibody K1 present on ovarian cancers and normal mesothelium. Cancer Res 2(1):181-186 (1992).
Chang et al. Molecular cloning of mesothelin, a differentiation antigen present on mesothelium, mesotheliomas, and ovarian cancers. PNAS USA 93:136-140 (1996).
Chen et al. Fusion protein linkers: Property, design and functionality. Advanced Drug Delivery Reviews 65:1357-1369 (2013).
Chen et al. Novel anti-CD3 chimeric antigen receptor targeting of aggressive T cell malignancies. Oncotarget 7(35):56219-56232 (2016).
Chen et al. Oncology Meets Immunology: The Cancer-Immunity Cycle. Immunity 39(1):1-10 (2013).
Cherkassky et al. Human Car T Cells With Cell-Intrinsic PD-1 Checkpoint Blockade Resist Tumor-Mediated Inhibition. J Clin Invest 126(8):3130-3144 (2016).
Chmielewski et al. of CARs and TRUCKs: Chimeric antigen receptor (CAR) T cells engineered with an inducible cytokine to modulate the tumor stroma, Immunological Reviews 257(1):83-90 (2014).
Chothia et al. Canonical structures for the hypervariable regions of immunoglobulins. J Mol Biol 196(4):901-917 (1987).
Chu et al. Targeting+ CD20 Aggressive B-cell Non-Hodgkin Lymphoma by Anti-CD20 CAR mRNA-Modified Expanded Natural Killer Cells In Vitro and in NSG Mice. Cancer Immunol Res 3(4):333-344 (2015).
Chylek, et al., Phosphorylation Site Dynamics of Early T-cell Receptor Signaling. PLOS One 9(8):e104240 (2014).
Cieri et al. Adoptive immunotherapy with genetically modified lymphocytes in allogeneic stem cell transplantation. Immun Rev 257(1):165-180 (2014).
Cieri et al. IL-7 and IL-15 instruct the generation of human memory stem T cells from naive precursors. Blood 121(4):573-584 (2013).
Cooper. Adoptive transfer of T cells genetically modified using the Sleeping Beauty system. Adoptive Transfer Session. 24th iSBTc Annual Meeting (30 pgs) (Oct. 31, 2009).
Cougot et al. 'Cap-tabolism'. Trends in Biochem Sci 29:436-444 (2001).
Couto et al. Anti-BA46 monoclonal antibody Mc3: humanization using a novel positional consensus and in vivo and in vitro characterization. Cancer Res 55(8):1717-1722 (1995).
Couto et al. Designing human consensus antibodies with minimal positional templates. Cancer Res 55(23 Supp):5973s-5977s (1995).
Cristaudo et al. Clinical significance of serum mesothelin in patients with mesothelioma and lung cancer. Clin. Cancer Res. 13:5076-5081 (2007).
D'Argouges. Combination of rituximab with blinatumomab (MT103/MEDI-538), a T cell-engaging CD19-/CD3-bispecific antibody, for highly efficient lysis of human B lymphoma cells. Leukemia Res 33:465-473 (2009).
Davila. Efficacy and toxicity management of 19-28z CAR T cell therapy in B cell acute lymphoblastic leukemia. Sci Transl Med 6(224):224ra25 (2014).
Davila et al. How do CARs work? Early insights from recent clinical studies targeting CD19. Oncoimmunology 1(9):1577-1583 (2012).
Dennehy et al. Cutting Edge: Monovalency of CD28 Maintains the Antigen Dependence of T Cell Costimulatory Responses. J Immunol 176(10):5725-5759 (2006).
Desmyter et al. Crystal structure of a camel single-domain VH antibody fragment in complex with lysozyme. Nat Struct Biol 3(9):803-811 (1996).
Ding et al. Abstract 2307: Preclinical evaluation of TC-210, a mesothelin-specific T cell receptor (TCR) fusion construct (TRUC™) T cells for the treatment of solid tumors. Cancer Res 79(Supp 13) (2019).
Ding et al. Abstract 3589: Preclinical evaluation of mesothelin-specific T cell receptor (TCR) fusion constructs (TRUC™s) utilizing the signaling power of the complete TCR complex: A new opportunity for solid tumor therapy. Cancer Res 78(Supp 13):3589 (2018).
Dong et al. B7-H1 pathway and its role in the evasion of tumor immunity. J Mol Med 81:281-287 (2003).
Dopfer et al. The CD3 conformational change in the Gamma Delta T cell receptor is not triggered by antigens but can be enforced to enhance tumor killing. Cell Reports 7(5):1704-1715 (2014).
Dotti et al. Design and Development of Therapies using Chimeric Antigen Receptor-Expressing T cells. Immunol Rev. 257(1):35 pgs (2014).
Draper, et al., Targeting of HPV-16+ Epithelial Cancer Cells by TCR Gene Engineered T Cells Directed against E6. Clin Cancer Res 21:4431-4440 (2015).
Dull et al. A third-generation lentivirus vector with a conditional packaging system. J Virol 72:8463-8471 (1998).
Durai et al., Zinc finger nucleases: custom-designed molecular scissors for genome engineering of plant and mammalian cells. Nucleic Acids Research 33(18):5978-5990 (2005).
Elango et al. Optimized transfection of mRNA transcribed from a d(A/T)100 tail-containing vector. Biochim Biophys Res Commun 330:958-966 (2005).
Esensten et al. CD28 Costimulation: From Mechanism to Therapy. Immunity 44:973-988 (2016).
Eshhar et al. Chimeric T cell receptor which incorporates the anti-tumour specificity of a monoclonal antibody with the cytolytic activity of T cells: a model system for immunotherapeutical approach. Br J Cancer 62:27-29 (1990).
Eshhar, et al., Specific activation and targeting of cytotoxic lymphocytes through chimeric single chains consisting of antibody-binding domains and the y or s subunits of the immunoglobulin and T-cell receptors. PNAS USA 90:720-724 (1993).
Fang et al. Immunotherapy for advanced melanoma. J Invest Derm 128(11):2596-2605 (2008).
Feng et al. A novel human monoclonal antibody that binds with high affinity to mesothelin-expressing cells and kills them by antibody-dependent cell-mediated cytotoxicity. Mol Cancer Ther 8(5):1113-1118 (2009).
Fielding, et al., Outcome of 609 adults after relapse of acute lymphoblastic leukemia (ALL); an MRC UKALL12/ECOG 2993 study. Blood 109(3):944-951 (2007).
Fife et al. Control of peripheral T-cell tolerance and autoimmunity via the CTLA-4 and PD-1 pathways. Immunol Rev 224:166-182 (2008).
Finer, et al., A High-Efficiency Retroviral Transduction System for Primary Human T Lymphocytes. Blood 83(1):43-50 (1994).
Finney et al. Activation of resting human primary T cells with chimeric receptors: costimulation from CD28, inducible costimulator, CD134, and CD137 in series with signals from the TCR zeta chain. J Immunol 172:104-113 (2004).

(56) References Cited

OTHER PUBLICATIONS

Finney et al. Chimeric Receptors Providing Both Primary and Costimulatory Signaling in T Cells from a Single Gene Product. J Immunol 161:2791-2797 (1998).
Ford et al. Synthesis of circular RNA in bacteria and yeast using RNA cyclase ribozymes derived from a group I intron of phage T4. PNAS USA 91:3117-3121 (1994).
Fraietta et al., Disruption of TET2 promotes the therapeutic efficacy of CD19-targeted T cells. Nature 558: 307-312 (2018).
Fraietta et al. Ibrutinib enhances chimeric antigen receptor T-cell engraftment and efficacy in leukemia. Blood 127(9):1117-1127 (2016).
Freeman et al. Engagement of the PD-1 immunoinhibitory receptor by a novel B7 family member leads to negative regulation of lymphocyte activation. J Exp Med 192:1027-1034 (2000).
Frigault et al. Chimeric antigen receptor-modified T cells strike back. Int Immunol 28(7):355-363 (2016).
Frigault, et al., Identification of Chimeric Antigen Receptors That Mediate Consitutive or Inducible Proliferation of T cells. Cancer Immunol Res 3(4):356-67 (2015).
Fu, et al., A Simple and Sensitive Method for Measuring Tumor-Specific T Cell Cytotoxicity. PLoS One 5(7):e11867 (2010).
Garfall. Chimeric Antigen Receptor T Cells against CD19 for Multiple Myeloma. N Engl J Med 373(11):1040-1047 (2015).
Gargett et al. Different cytokine and stimulation conditions influence the expansion and immune phenotype of third-generation chimeric antigen receptor T cells specific for tumor antigen GD2. Cytotherapy 17(4):487-495 (2015).
Garland et al. The use of Teflon cell culture bags to expand functionally active CD8+ cytotoxic T lymphocytes. J Immunol Meth 227(1-2):53-63 (1999).
Garrido et al. The urgent need to recover MHC class I in cancers for effective immunotherapy. Current Opinion in Immunology 39:44-51 (2016).
Gattinoni, et al. A Human memory T cell subset with stem cell-like properties. Nat Med 17(10):1290-1298 (2011).
Gattinoni, et al., Moving T memory stem cells to the clinic. Blood 121(4):567-569 (2013).
Gattinoni et al. Paths to stemness: building the ultimate antitumour T cell. Nature Reviews Cancer 12(10):671-684 (2012).
Gattinoni, et al., T memory stem cells in health and disease. Nat Med 23(1):18-27 (2017).
Gaud, et al., Regulatory mechanisms in T cell receptor signalling. Nat Rev Immunol 18:485-497 (2018).
Gentles et al., The prognostic landscape of genes and infiltrating immune cells across human cancers, Nature Medicine, 21(8): 938-945 (2015).
Geraerts, et al., Comparison of lentiviral vector titration methods. BMC Biotechnology 6:34 (2006).
Ghosh et al. Design of Lipsomes for circumventing the reticuloendothelial cells. Glycobiology 5:505-510 (1991).
Ghosh et al. Donor CD19 CAR T cells exert potent graft-versus-lymphoma activity with diminished graft-versus-host activity. Nature Medicine 23:242-249 (2017).
Goding et al. Restoring immune function of tumor-specific CD4+ T cells during recurrence of melanoma. J Immunol 190(9):4899-4909 (2013).
Gorochov et al. Functional assembly of chimeric T-cell receptor chains. Int J Cancer Supp 7:53-57 (1992).
Govers et al. TCRs Genetically Linked to CD28 and CD3ε Do Not Mispair with Endogenous TCR Chains and Mediate Enhanced T Cell Persistence and Anti-Melanoma Activity. J Immunol 193:5315-5326 (2014).
Griffin et al. Antibody fragments as tools in crystallography. Clin Exp Immunol 165(3):285-291 (2011).
Gros et al. PD-1 identifies the patient-specific CD8+ tumor-reactive repertoire infiltrating human tumors. The Journal of clinical investigation, 124(5):2246-2259 (2014).
Gross et al. Generation of effector T cells expressing chimeric T cell receptor with antibody type-specificity. Transplant Proc. 21(1 Pt 1):127-130 (1989).
Grupp et al. Chimeric antigen receptor-modified T cells for acute lymphoid leukemia. NEJM 368:1509-1518 (2013).
Guedan et al. ICOS-based chimeric antigen receptors program bipolar TH17/TH1 cells. Blood 124(7):1070-1080 (2014).
Guest et al. The role of extracellular spacer regions in the optimal design of chimeric immune receptors: evaluation of four different scFvs and antigens. J Immunother 28(3):203-211 (2005).
Guo, et al., Chimeric Antigen Receptor-Modified T Cells for Solid Tumors: Challenges and Prospects. J Immunol Res 2016:3850839 (2016).
Guy et al. Distinct T cell receptor signaling pathways drive proliferation and cytokine production in T cells. Nat Immunol 14(3):262-270 (2013).
Guy et al. Distinct T cell receptor signaling pathways drive proliferation and cytokine production in T cells. Nat Immunol 14(3):262-270 and Supp pp. 1-9 (2013).
Haanen et al. Selective expansion of cross-reactive CD8(+) memory T cells by viral variants. J Exp Med 190(9):1319-1328 (1999).
Haas, et al., Phase I study of lentiviral-transduced chimeric antigen receptor modified T cells recognizing mesothelin in advanced solid cancers. Mol Ther 27(11):1919-1929 (2019).
Haks, et al., A Redundant Role of the CD3y-Immunoreceptor Tyrosine-Based Activation Motif in Mature T Cell Function. J Immunol 166(4):2576-2588 (2001).
Hammill, et al., Viral Engineering of Chimeric Antigen Receptor Expression on Murine and Human T Lymphocytes. Method Mol Biol 1458:137-157 (2016).
Hardy, et al., Implications of T cell receptor biology on the development of new T cell therapies for cancer. Immunotherapy 12(1):89-103 (2020).
Hassan et al. Major Cancer Regressions in Mesothelioma After Treatment with an Anti-Mesothelin Immunotoxin and Immune Suppression. Sci Transl Med 5:208ra147 (2013).
Hassan et al. Mesothelin: a new target for immunotherapy. Clin Cancer Res 10:3937-3942 (2004).
Hassan et al. Mesothelin is overexpressed in pancreaticobiliary adenocarcinomas but not in normal pancreas and chronic pancreatitis. Am J Clin Pathol 124(6):838-845 (2005).
Hassan et al. Mesothelin targeted cancer immunotherapy. Eur J Cancer 44:46-53 (2008).
Hatzoglou et al. TNF receptor family member BCMA (B cell maturation) associates with TNF receptor-associated factor (TRAF) 1, TRAF2, and TRAF3 and activates NF-kappa B, elk-1, c-Jun N-terminal kinase, and p38 mitogen-activated protein kinase. Immunology 165(3):1322-1330 (2000).
Hay, et al., Kinetics and Biomarkers of Severe Cytokine Release Syndrome after CD19 Chimeric Antigen Receptor-Modified T Cell Therapy. Blood 130(21):2295-2306 (2017).
Hayes, et al., Distinct Structure and Signaling Potential of the TCR Complex. Immunity 16:827-838 (2002).
Helsen, et al., Tri-functional t cell Receptor antigen coupler (Tri-TAC): a novel method to direct T cells against tumors. Journal for Immuno Therapy of Cancer 2(Suppl 3):1-1 (2014).
Hicklin et al. HLA class I antigen downregulation in human cancers: T-cell immunotherapy revives and old story. Mol Med Today 5(4):178-186 (1999).
Ho et al. Mesothelin expression in human lung cancer. Clin Cancer Res 13:1571-1575 (2007).
Holdt et al.: Circular RNAs as Therapeutic Agents and Targets. Front Physiol. 9: 1262, 16 pages total (2018).
Holdt et al., Molecular roles and function of circular RNAs in eukaryotic cells. Cell Mol Life Sci 75(6):1071-1098 (2018).
Holehonnur, et al., The production of viral vectors designed to express large and difficult to express transgenes within neurons. Mol Brain 8:12 (2015).
Holliger et al. “Diabodies”: small bivalent and bispecific antibody fragments. PNAS USA 90(14):6444-6448 (1993).
Holst et al. Scalable signaling mediated by T cell antigen receptor-CD3 ITAMs ensures effective negative selection and prevents autoimmunity. Nat Immunol 9(6):658-666 and Supp pp. 1-21 (2008).

(56) References Cited

OTHER PUBLICATIONS

Holzinger et al. The growing world of CAR T cell trials: a systematic review, Cancer Immunology. Immunotherapy 65(12):1433-1450 (2016).
Hombach et al. T cell activation by antibody-like immunoreceptors: the position of the binding epitope within the target molecule determines the efficiency of activation of redirected T cells. J Immunol 178:4650-4657 (2007).
Huang et al. Driving an improved CAR for cancer immunotherapy. J Clin Invest 126(8):2795-2798 (2016).
Hudecek et al. Receptor affinity and extracellular domain modifications affect tumor recognition by ROR1-specific chimeric antigen receptor T cells. Clin Cancer Res 19(12):3153-3164 (2013).
Hudecek et al. The Nonsignaling Extracellular Spacer Domain of Chimeric Antigen Receptors Is Decisive for In Vivo Antitumor Activity. Cancer Immunol Res 3(2):125-135 (2015).
Huehls, et al., Bispecific T-cell engagers for cancer immunotherapy. Immunol Cell Biol 93:290-296 (2015).
Hui et al. T cell costimulatory receptor CD28 is a primary target for PD-1-mediated inhibition. Science 355:1428-1433 (2017).
Humpries. Adoptive cell therapy: Honing that killer instinct. Nature 504(7480):S13-5 (2013).
Hunter et al. Combinatorial proteomic analysis of intercellular signaling applied to the CD28 T-cell costimulatory receptor. PNAS USA 112:E1594-1603 (2015).
Huston et al. Protein engineering of antibody binding sites: recovery of specific activity in an anti-digoxin single-chain Fv analogue produced in *Escherichia coli*. PNAS USA 85(16):5879-5883 (1988).
Hwan et al. Universal Chimeric Antigen Receptors for Multiplexed and Logical Control of T Cell Responses. Cell 173(6):1426-1438.e11 (2018).
Hwang, et al., TCR ITAM multiplicity is required for the generation of follicular helper T-cells. Nature 6:6982 (2015).
Illei et al. Mesothelin Expression in Advanced Gastroesophageal Cancer Represents a Novel Target for Immunotherapy. Appl Immunohistochem Mol Morphol 24(4):246-252 (2016).
Inaguma et al. Comprehensive immunohistochemical study of mesothelin (MSLN) using different monoclonal antibodies 5B2 and MN-1 in 1562 tumors with evaluation of its prognostic value in malignant pleural mesothelioma. Oncotarget 8(16):26744-26754 (2017).
Inoue, et al., High-Fidelity Correction of Mutations at Multiple Chromosomal Positions by Adeno-Associated Virus Vectors. J Virol 73(9):7376-7380 (1999).
Institute for Clinical and Economic review (ICER). Chimeric Antigen Receptor T-Cell Therapy for B-Cell Cancers: Effectiveness and Value. Final Evidence Report dated Mar. 23, 2018 (185 pgs).
Iwahori et al. Engager T cells: a new class of antigen-specific T cells that redirect bystander T cells. Mol Ther 23(1):171-178 (2015).
Izumoto et al. Phase II clinical trial of Wilms tumor 1 peptide vaccination for patients with recurrent glioblastoma multiforme. J Neurosurg 108:963-971 (2008).
Jackson et al. Driving CAR T-cells forward. Nat Rev Clin Oncol 13(6):370-383 (2016).
Jacoby. CD19 Car immune pressure induces B-precursor acute lymphoblastic leukaemia lineage switch exposing inherent leukaemic plasticity. Nat Commun 7:12320 (2016).
Jacoby et al. Murine models of acute leukemia: important tools in current pediatric leukemia research. Front Oncol 4:95 (2014).
James et al. Antibody-mediated B-cell depletion before adoptive immunotherapy with T cells expressing CD20-specific chimeric T-cell receptors facilitates eradication of leukemia in immunocompetent mice. Blood 114(27):5454-5463 (2009).
James et al. Antigen sensitivity of CD22-specific chimeric TCR is modulated by target epitope distance from the cell membrane. J Immunol 180:7028-7038 (2008).
Jamnani et al. T cells expressing VHH-directed oligoclonal chimeric HER2 antigen receptors: towards tumor-directed oligoclonal T cell therapy. Biochim Biophys Acta 1840(1):378-386 (2014).
Jeck et al. Detecting and characterizing circular RNAs. Nat Niotechnol 32(5):453-461 (2014).
Jena et al. Chimeric antigen receptor (CAR)-specific monoclonal antibody to detect CD19-specific T cells in clinical trials. PLoS One. 8(3):e57838 (2013).
Jin et al. Safe engineering of CAR T cells for adoptive cell therapy of cancer using long-term episomal gene transfer. EMBO Mol Med 8(7):702-711 (2016).
John et al. Anti-PD-1 antibody therapy potently enhances the eradication of established tumors by gene-modified T cells. Clin Cancer Res 19(20):5636-5646 (2013).
Johnson et al. Rational development and characterization of humanized anti-EGFR variant III chimeric antigen receptor T cells for glioblastoma. Immunotherapy 7(275):275ra22 (2015).
Jones et al. Replacing the complementarity-determining regions in a human antibody with those from a mouse. Nature 321:522-525 (1986).
Jonnalagadda et al. Chimeric Antigen Receptors With Mutated IgG4 Fc Spacer Avoid Fc Receptor Binding and Improve T Cell Persistence and Antitumor Efficacy. Mol Ther 23(4):757-768 (2015).
Juillerat, et al., Design and analysis of stably integrated reporters for inducible transgene expression in human T cells and CAR NK-cell lines. Nature 12(Suppl 2):44 (2015).
June. Remote Controlled CARs: Towards a Safer Therapy for Leukemia. Cancer Immunol Res 4(8):643 (2016).
June et al. Chimeric Antigen Receptor Therapy. N Engl J Med 379:64-73 (2018).
June et al. Engineering lymphocyte subsets: tools, trials and tribulations. Nat Rev Immunol 9.10:704-716 (2009).
June et al. Is autoimmunity the Achilles' heel of cancer immunotherapy? Nat Med 23(5):540-547 (2017).
Junghans. The challenges of solid tumor for designer CAR-T therapies: a 25-year perspective. Cancer Gene Ther 24(3):89-99 (2017).
Kabat et al. Sequences of Proteins of Immunological Interest. NIH Pub. No. 91-3242. Public Health Service, National Institutes of Health. 1:647-669 (1991).
Kachala et al. Mesothelin Overexpression Is a Marker of Tumor Aggressiveness and Is Associated with Reduced Recurrence-Free and Overall Survival in Early-Stage Lung Adenocarcinoma. Clin Cancer Res 20(4):1020-1028 (2013).
Kaiser. Towards a commercial process for the manufacture of genetically modified T cells for therapy. Cancer Gene Thera 22(2):72-78 (2015).
Kalos et al. T cells with chimeric antigen receptors have potent antitumor effects and can establish memory in patients with advanced leukemia. Sci Transl Med 3(95):95ra73 (2011).
Karim et al. Tumor-expressed B7-H1 and B7-DC in relation to PD-1+ T-cell infiltration and survival of patients with cervical carcinoma. Clin Cancer Res. 15(20):6341-6347 (2009).
Karlsson et al. Evaluation of Intracellular Signaling Downstream Chimeric Antigen Receptors. PLoS One 10(12):e0144787 (2015).
Karyampudi et al. Accumulation of Memory Precursor CD8 T Cells in Regressing Tumors following Combination Therapy with Vaccine and Anti-PD-1 Antibody. Cancer Res 74(11):2974-85 (2014.
Kaufman, et al., Oncolytic viruses: a new class of immunotherapy drugs. Nature 14:642-663 (2015).
Kawalekar et al. Distinct Signaling of Coreceptors Regulates Specific Metabolism Pathways and Impacts Memory Development in CAR T Cells. Immunity 44(2):380-390 (2016).
Kawalekar et al. Supplemental Information. Distinct Signaling of Coreceptors Regulates Specific Metabolism Pathways and Impacts Memory Development in CAR T Cells. Immunity 44(2):380-390 (2016).
Kebriaei et al. Phase I trials using Sleeping Beauty to generate CD19-specific CAR T cells. J Clin Invest 126(9):3363-3376 (2016).
Kershaw et al. Gene-engineered T cells for cancer therapy. Nat Rev Cancer 13(8):525-541 (2013).
Khan, et al., Engineering of Human Pluripotent Stem Cells by AAV-mediated Gene Targeting. Mol Ther 18(6):1192-1199 (2010).
Kim, et al., High Cleavage Efficiency of a 2A Peptide Derived from Porcine Teschovirus-1 in Human Cell Lines, Zebrafish and Mice. PLoS One 6(4):e18556 (2011).

(56) References Cited

OTHER PUBLICATIONS

Klebanoff et al. Memory T cell-driven differentiation of naive cells impairs adoptive immunotherapy. J Clin Invest 126(1):318-334 (2016).
Klebanoff et al. Prospects for gene-engineered T cell immunotherapy for solid cancers. Nat Med 22(1):26-36 (2016).
Knies et al. An optimized single chain TCR scaffold relying on the assembly with the native CD3-complex prevents residual mispairing with endogenous TCRs in human T-cells. Oncotarget 7(16):21199-211221 (2016).
Kochenderfer et al. B-cell depletion and remissions of malignancy along with cytokine-associated toxicity in a clinical trial of anti-CD19 chimeric-antigen-receptor-transduced T cells. Blood 119(12):2709-2720 (2012).
Kochenderfer et al. Construction and Pre-clinical Evaluation of an Anti-CD19 Chimeric Antigen Receptor. Immunotherapy 32(7):689-702 (2010).
Kojima et al. Molecular cloning and expression of megakaryocyte potentiating factor cDNA. J Biol Chem 270:21984-21990 (1995).
Koneru et al. IL-12 secreting tumor-targeted chimeric antigen receptor T cells eradicate ovarian tumors in vivo. OncoImmunology 4(3):e994446 (2015).
Konishi et al. B7-H1 expression on non-small cell lung cancer cells and its relationship with tumor-infiltrating lymphocytes and their PD-1 expression. Clin Cancer Res 10:5094-5100 (2004).
Kowolik et al. CD28 costimulation provided through a CD19-specific chimeric antigen receptor enhances in vivo persistence and antitumor efficacy of adoptively transferred T cells. Cancer Res 66(22):10995-11004 (2006).
Krenciute et al. Characterization and Functional Analysis of scFv-based Chimeric Antigen Receptors to Redirect T Cells to IL13Rα2-positive Glioma. Mol Ther 24(2):354-363 (2016).
Kuhns et al. TCR Signaling Emerges from the Sum of Many Parts. Front. Immunol. 3:159 (2012).
Kunert et al. TCR-engineered T cells meet new challenges to treat solid tumors: Choice of antigen, T cell fitness, and sensitization of tumor milieu. Front Immun 4:363 (2013).
Kunkele et al. Functional Tuning of CARs Reveals Signaling Threshold above Which CD8+ CTL Antitumor Potency Is Attenuated due to Cell Fas-FasL-Dependent AICD. Cancer Immunol Res 3(4):368-379 (2015).
Laabi et al. A new gene, BCM, on chromosome 16 is fused to the interleukin 2 gene by a t(4;16)(q26;p13) translocation in a malignant T cell lymphoma. EMBO 11(11):3897-3904 (1992).
Laabi et al. The BCMA gene, preferentially expressed during B lymphoid maturation, is bidirectionally transcribed. Nucleic Acids Res 22(7):1147-1154 (1994).
Labri, et al., From Truly Naïve to Exhausted Senescent T Cells: When Markers Predict Functionality. Cytometry Part A 85(1):25-35 (2014).
Lamer, et al., Treatment of metastatic renal cell carcinoma (mRCC) with CAIX CAR-engineered T-cells-a completed study overview. Biochem Soc Trans 44(3):951-959 (2016).
Langer. Comparative Evaluation of Peripheral Blood T Cells and Resultant Engineered Anti-CD19 Car T-Cell Products From Patients With Relapsed / Refractory Non-Hodgkin Lymphoma (NHL). Abstract 2305 AACR Apr. 16-20, 2016 (1 pg.).
Lanier. NKG2D Receptor and Its Ligands in Host Defense. Cancer Immunol Res. 3(6):575-582 (2015).
Lanitis et al. Chimeric antigen receptor T Cells with dissociated signaling domains exhibit focused antitumor activity with reduced potential for toxicity in vivo. Cancer Immunol Res 1(1):45-53 (2013).
Lanitis et al. Redirected Antitumor Activity of Primary Human Lymphocytes Transduced With a Fully Human Anti-mesothelin Chimeric Receptor. Mol Ther 20(3):633-643 (2012).
Lanzavecchia et al. The use of hybrid hybridomas to target human cytotoxic T lymphocytes. Eur J Immunol. 17(1):105-111 (1987).
Latchman et al. PD-L2 is a second ligand for PD-1 and inhibits T cell activation. Nat Immunol 2:261-268 (2001).
Leddon et al. The CD28 Transmembrane Domain Contains an Essential Dimerization Motif. Front Immunol 2020; 11:1519 (2020).
Lee et al. Current concepts in the diagnosis and management of cytokine release syndrome. Blood 124(2):188-196 (2014).
Lee et al. T cells expressing CD19 chimeric antigen receptors for acute lymphoblastic leukaemia in children and young adults: A phase 1 dose-escalation trial. The Lancet 385(9967):517-528 (2014).
Leen et al. Improving T cell therapy for cancer. Annu Rev Immunol 25:243-265 (2007).
Legat, et al., Inhibitory receptor expression depends more dominantly on differentiation and activation than exhaustion of human CD8 T cells. Front Immunol 4:455 (2013).
Leone et al. MHC Class I Antigen Processing and Presenting Machinery: Organization, Function, and Defects in Tumor Cells. J Natl Cancer Inst 105:1172-1187 (2013).
Lesch et al. PD-1-CD28 fusion protein strengthens mesothelin-specific TRuC T cells in preclinical solid tumor models. Cell Oncol (Dordr) PMID: 36409438 (2022).
Li et al. Adoptive Immunotherapy Using T Lymphocytes Redirected to glypican-3 for the Treatment of Lung Squamous Cell Carcinoma. Oncotarget. 7(3):2496-507 (2016).
Li et al. Enhanced Cancer Immunotherapy by Chimeric Antigen Receptor-Modified T Cells Engineered to Secrete Checkpoint Inhibitors. Clin Cancer Res 23(22):6982-6992 (2017).
Li et al., Expression of glucocorticoid induced TNF receptor family related protein (GITR) on peripheral T cells from normal human donors and patients with non-infectious uveitis. J. Autoimmunity 21:83-92 (2003).
Lipowska-Bhalla et al. Targeted immunotherapy of cancer with CAR T cells: Achievements and challenges. Cancer Immunol Immuno 61(7):953-962 (2012).
Liu et al. Affinity-Tuned ErbB2 or EGFR Chimeric Antigen Receptor T Cells Exhibit an Increased Therapeutic Index against Tumors in Mice. Cancer Res 75(17):3596-3607 (2015).
Liu et al. Improved anti-leukemia activities of adoptively transferred T cells expressing bispecific T-cell engager in mice. Blood Cancer J 6:e430 (2016).
Liu et al. Supplemental Information. A Chimeric Switch-Receptor Targeting PD1 Augments the Efficacy of Second-Generation CAR T Cells in Advanced Solid Tumors. Cancer Res 76(6):1578-1590 (2016).
Long et al. 4-1BB Costimulation Ameliorates T Cell Exhaustion Induced by Tonic Signaling of Chimeric Antigen Receptors. Nat Med 21(6):581-590 (2015).
Love et al. ITAM-mediated signaling by the T-cell antigen receptor. Cold Spring Harb Perspect Biol. 2(6):a002485 (2010).
Lu et al. Treatment of Patients With Metastatic Cancer Using a Major Histocompatibility Complex Class II-Restricted T-Cell Receptor Targeting the Cancer Germline Antigen MAGE-A3. J Clin Oncol 35(29):3322-3329 (2017).
Ma et al. Versatile strategy for controlling the specificity and activity of engineered T cells. PNAS 113(4):E450-E458 (2016).
Maeder et al., Genome-editing Technologies for Gene and Cell Therapy. Mol Ther. 24(3):430-446 (2016).
Maher et al. Human T-lymphocyte cytotoxicity and proliferation directed by a single chimeric TCRzeta /CD28 receptor. Nat Biotech 20(1):70-75 (2002).
Mahmoud et al. Enforced CD19 expression leads to growth inhibition and reduced tumorigenicity. Blood 94(10):3551-3558 (1999).
Mahmoudjafari, et al., American Society for Blood and Marrow Transplantation Pharmacy Special Interest Group Survey on CAR T Cell Therapy Administrative, Logistical and Toxicity Management Practices in the United States. Biology of Blood and Marrow Transplantation. Cell Ther 25(1):P26-33 (2018).
Majzner, et al., Clinical lessons learned from the first leg of the CAR T cell journey. Nat Med 25:1341-1355 (2019).
Mak et al. TAL effectors: function, structure, engineering and applications. Curr Opin Struct Biol. 23:93-9 (2013).
Mali. Delivery systems for gene therapy. Indian J. Hum. Genet. 19:3-8 (2013).
Mali et al. Cas9 as a versatile tool for engineering biology. Nat Methods 10:957-963 (2013).

(56) References Cited

OTHER PUBLICATIONS

Malissen, et al., Early T Cell Activation: Integrating Biochemical, Structural, and Biophysical Cues Annu. Rev. Immunol. 33:539-561 (2015).
Mardiros, et al., Acute myeloid leukemia therapeutics CARs in the driver's seat. OncoImmunology 2(12):e27214 (2013).
Maude et al. CD19-targeted chimeric antigen receptor T-cell therapy for acute lymphoblastic leukemia. Blood 125(26):4017-4024 (2015).
Maude, et al., Chimeric Antigen Receptor T Cells for Sustained Remissions in Leukemia. N. Engl J. Med (2014) 371(16) 1507-1517. With correction published N. Engl J. Med 374(10):998 (2016).
Maude, et al., Managing Cytokine Release Syndrome Associated with Novel T Cell-Engaging Therapies. Cancer J. 20(2):119-122 (2014).
Maus et al. Adoptive immunotherapy for cancer of viruses. Annual Review of Immunology 32:189-225 (2014).
Maus et al. Ex vivo expansion of polyclonal and antigen-specific cytotoxic T lymphocytes by artificial APCs expressing ligands for the T-cell receptor, CD28 and 4-1BB. Nature Biotech 20(2):143-148 (2002).
Maus et al. Making Better Chimeric Antigen Receptors for Adoptive T-cell Therapy. Clin Cancer Res 22(8):1875-1884 (2016).
Maus et al. T Cells Expressing Chimeric Antigen Receptors Can Cause Anaphylaxis in Humans. Cancer Immunol Res. 1:26-31 (2013).
Maus et al. Zoom zoom: Racing CARs for multiple myeloma. Clin Cancer Res 19(8):1917-1919 (2013).
Menk et al. 4-1BB costimulation induces T cell mitochondrial function and biogenesis enabling cancer immunotherapeutic responses. J Exp Med 215(4):1091-1100 (2018).
Merry et al. O-glycan sialylation and the structure of the stalk-like region of the T cell co-receptor CD8. J Biol Chem 278(29):27119-27128 (2003).
Miller et al. CD19-Targeted CAR T Cells: A New Tool in the Fight against B Cell Malignancies. Oncol Res Treat 38(12):683-690 (2015).
Milone et al. Chimeric receptors containing CD137 signal transduction domains mediate enhanced survival of T cells and increased antileukemic efficacy in vivo. Mol Ther 17(8):1453-1464 (2009).
Minguet et al. A permissive geometry model for TCR-CD3 activation. Trends in Biochemical Sciences 33(2):51-57 (2008).
Minguet et al. Full Activation of the T Cell Receptor Requires Both Clustering and Conformational Changes at CD3. Immunity 26(1):43-54 (2007).
Moon et al. Expression of a functional CCR2 receptor enhances tumor localization and tumor eradication by retargeted human T cells expressing a mesothelin-specific chimeric antibody receptor. Clin Cancer Res 17(14):4719-4730 (2011).
Morea et al. Antibody modeling: implications for engineering and design. Methods 20(3):267-279 (2000).
Morello et al. Mesothelin-Targeted CARs: Driving T Cells to Solid Tumors. Cancer Discov 6(2):133-146 (2016).
Morton et al. Establishment of human tumor xenografts in immunodeficient mice. Nat Procol 2:247 (2007).
Mosquera et al. In vitro and in vivo characterization of a novel antibody-like single-chain TCR human IgG1 fusion protein. J Immunol 174(7):4381-4388 (2005).
Motz, et al., Deciphering and Reversing Tumor Immune Suppression. Immunity 39:61-73 (2013).
Moynihan et al. Eradication of large established tumors in mice by combination immunotherapy that engages innate and adaptive immune responses. Nat Med 12(22):1402-1410 (2016).
Mueller, et al., Cellular kinetics of CTL019 in relapsed/refractory B-cell acute lymphoblastic leukemia and chronic lymphocytic leukemia. Blood 130(21):2317-2325 (2017).
Nacheva et al. Preventing nondesired RNA-primed RNA extension catalyzed by T7 Rna polymerase. Eur J Biochem 270:1458-1465 (2003).
Needleman et al. A general method applicable to the search for similarities in the amino acid sequence of two proteins. J. Mol. Biol. 48:443-453 (1970).
Newick et al. Chimeric antigen receptor T-cell therapy for solid tumors. Mol Ther Oncolytics 3:16006 (2016).
Nicholson et al. Construction and characterisation of a functional CD19 specific single chain Fv fragment for immunotherapy of B lineage leukaemia and lymphoma. Mol Immun 34(16-17):1157-1165 (1997).
Nishikawa et al. Nonviral vectors in the new millennium: delivery barriers in gene transfer. Human Gene Therapy. 12:861-870 (2001).
Niyonzima et al. Tuning DNA binding affinity and cleavage specificity of an engineered gene-targeting nuclease via surface display, flow cytometry and cellular analyses. Protein Eng Des Sel. 30(7):503-522 (2017).
Nocentini et al., Pharmacological modulation of GITRL/GITR system: therapeutic perspectives. Br. J. Pharmacol., 165:2089-2099 (2012).
Nolan et al. Bypassing immunization: optimized design of "designer T cells" against carcinoembryonic antigen (CEA)-expressing tumors, and lack of suppression by soluble CEA. Clin Cancer Res 5:3928-3941 (1999).
NP 000064, human T-cell surface glycoprotein CD3 gamma chain precursor, NCBI, pp. 1-4, May 4, 2019.
NP 000724, human T-cell surface glycoprotein CD3 epsilon chain precursor, NCBI, pp. 1-4, May 4, 2019.
Oden et al. Potent anti-tumor response by targeting B cell maturation antigen (BCMA) in a mouse model of multiple myeloma. Mole Oncol 9(7):1348-1358 (2015).
O'Hare et al. Mesothelin as a target for chimeric antigen receptor-modified T cells as anticancer therapy. Immunotherapy 8(4):449-460 (2016).
Ohtsuka et al. An alternative approach to deoxyoligonucleotides as hybridization probes by insertion of Deoxyinosine at Ambiguous Codon Positions. J Biol Chem 260(5):2605-2608 (Mar. 10, 1985).
Okkenhaug et al. Grb2 forms an inducible protein complex with CD28 through a Src homology 3 domain-proline interaction. J Biol Chem 273:21194-21202 (1998).
Onda et al. New Monoclonal Antibodies to Mesothelin Useful for Immunohistochemistry, Fluorescence-Activated Cell Sorting, Western Blotting, and ELISA. Clin Cancer Res 11(16):5840-5846 (2005).
Ordonez. Application of mesothelin immunostaining in tumor diagnosis. Am J Surg Pathol 27:1418-1428 (2003).
Padlan, et al., A possible procedure for reducing the immunogenicity of antibody variable domains while preserving their ligand-binding properties. Mol Immunol 28(4-5):489-498 (1991).
Park et al. Adoptive Immunotherapy for B-cell Malignancies with Autologous Chimeric Antigen Receptor Modified Tumor Targeted T Cells. Disc Med 9(47):277-288 (2010).
Park, et al., Adoptive Transfer of Chimeric Antigen Receptor Re-directed Cytolytic T Lymphocyte Clones in Patients with Neuroblastoma. Mol Ther 15(4):825-833 (2007).
Pastan et al. Discovery of Mesothelin and Exploiting It as a Target for Immunotherapy. Cancer Res 74(11):2907-2912 (2014).
Patel et al. Engineering an APRIL-specific B Cell Maturation Antigen. J Bio Chem 279(16):16727-16735 (2004).
Patel et al. PDL-1 Expression as a Predictive Biomarker in cancer Immunotherapy. Mol Cancer Ther 14(4):847-856 (2015).
PCT/US2016/033146 International Search Report and Written Opinion dated Oct. 20, 2016.
PCT/US2019/032298 International Search Report and Written Opinion dated Jul. 15, 2020.
Pearson et al. Improved Tools for Biological Sequence Comparison. PNAS USA 85:2444-48 (1988).
Pedersen et al. Comparison of surface accessible residues in human and murine immunoglobulin Fv domains. Implication for humanization of murine antibodies. J Mol Biol 235(3):959-973 (1994).
Perriman et al.: Circular mRNA can direct translation of extremely long repeating-sequence proteins in vivo. RNA 4(9): 1047-1054 (1998).
Philip et al. A highly compact epitope-based marker suicide gene for safer and easier adoptive T-cell gene therapy. Blood 124:1277-1287 (2014).

(56) References Cited

OTHER PUBLICATIONS

Pipeline. A Broad Pipeline of T Cell Therapies For Solid And Hematologi Cancers. TCR2 Therapeutics. Available at https://www.tcr2.com/pipeline (Accessed Apr. 15, 2020) (5 pgs).

Pitts, et al., Resistance Mechanisms to Immune-Checkpoint Blockade in Cancer: Tumor-Intrinsic and -Extrinsic Factors. Immunity 44:1255-1269 (2016).

Porter et al. Chimeric antigen receptor T cells persist and induce sustained remissions in relapsed refractory chronic lymphocytic leukemia. Sci Trans Med 7(303):303ra319 (2015).

Porter et al. Chimeric antigen receptor-modified T cells in chronic lymphoid leukemia. NEJM 365:725-733 (2011).

Porter et al. Pilot study of redirected autologous t cells engineered to contain anti-CD19 attached to TCRZ and 4-1BB signaling domains in patients with chemotherapy resistant or refractory CD19+ leukemia and lymphoma. NCT02374333. Available at https://www.clinicaltrials.gov/ct2/show/NCT02374333?term=13BT022 (3 pgs.) (2016).

Posey et al. Engineered CAR T Cells Targeting the Cancer-Associated Tn-Glycoform of theMembraneMucinMUC1 Control Adenocarcinoma. Immunity 44:1444-1454 (2016).

Pranter, et al., Anti-Mesothelin Nanobodies for Both Conventional and Nanoparticle-Based Biomedical Applications. J Bio Nanotechnol 11:1201-1212 (2015).

Presta: Antibody Engineering. Curr Op Struct Biol 2:593-596 (1992).

Presta et al. Humanization of an antibody directed against IgE. J Immunol 151:2623-2632 (1993).

Prosser et al. Mechanistic Studies of PD-1 Signaling in the Conversion of Effector T Cells to Functional Exhaustion. Abstract 565. Mol Ther 17(Supp 1):S216 (2009).

Prosser, Megan E. Development of Genetic Engineering Platforms to Protect T Cells Against Functional Exhaustion. Dissertation. Irell and Maella Graduate School of Biological Sciences of City of Hope Duarte, CA (2011).

Pule et al. A chimeric T cell antigen receptor that augments cytokine release and supports clonal expansion of primary human T cells. Mol Ther 12(5):933-941 (2005).

Pule, et al., Artificial T-cell receptors. Cytotherapy 5(3):211-26 (2003).

Punt et al. Stoichiometry of the T cell antigen receptor (TCR) complex: each TCR/CD3 complex contains one TCR alpha, one TCR beta, and two CD3 epsilon chains. J Exp Med 180(2):587-593 (1994).

Puttaraju et al. Generation of nuclease resistant circular RNA decoys for HIV-Tat and HIV-Rev by autocatalytic splicing. Nucleic Acids Symp Ser 33:152-155 (1995).

Puttaraju et al. Generation of nuclease resistant circular RNA decoys for HIV-Tat and HIV-Rev by autocatalytic splicing. Nucleic Acids Symp Ser 33:49-51 (1995).

Qasim, et al., Progress and prospects for engineered T cell therapies. Br J Haematol 166:818-829 (2014).

Radcliff, et al., Multiple gene products from a single vector: 'self-cleaving' 2A peptides. Gene Ther 11:1673-1674 (2004).

Rafiq, et al., Engineering strategies to overcome the current roadblocks in CAR T cell therapy. Nat Rev Clin Oncol 17(3):147-167 (2019).

Ran et al. Genome engineering using the CRISPR-Cas9 system. Nature Protocols 8:2281-2308 (2013).

Riches, et al., T cells from CLL patients exhibit features of T-cell exhaustion but retain capacity for cytokine production. Blood 121(9):1612-1622 (2013).

Riechmann et al. Reshaping human antibodies for therapy. Nature 332(6162):323-7 (1988).

Riolobos, et al., HLA Engineering of Human Pluripotent Stem Cells. Mol Ther 21(6):1232-1241 (2013).

Rivadeneira et al. Antitumor T cell reconditioning: improving metabolic fitness for optimal cancer immunotherapy. Clin Cancer Res 24(11):2473-2481 (2018).

Rodgers et al. Switch-mediated activation and retargeting of CAR-T cells for B-cell malignancies. PNAS USA 113(4):E459-E468 (2016).

Rodriguez-Garcia et al. T-cell target antigens across major gynecologic cancers. Gynecologic Oncology 145(3):426-435 (2017).

Roguska et al. A comparison of two murine monoclonal antibodies humanized by CDR-grafting and variable domain resurfacing. Protein Eng 9(10):895-904 (1996).

Roguska et al. Humanization of murine monoclonal antibodies through variable domain resurfacing. PNAS 91:969-973 (1994).

Rohrs et al. ERK Activation in CAR T Cells Is Amplified by CD28-Mediated Increase in CD3zeta Phosphorylation. iScience 23:101023 (2020).

Rosenberg. Cell transfer immunotherapy for metastatic solid cancer—what clinicians need to know. Nat Rev Clin Oncol. 8(10):577-585 (2011).

Rosenberg et al. Adoptive cell transfer as personalized immunotherapy for human cancer. Science 348(6230):62-68 (2015).

Rosenberg et al. Use of tumor-infiltrating lymphocytes and interleukin-2 in the immunotherapy of patients with metastatic melanoma. A preliminary report. NEJM 319:1676 (1988).

Rossolini et al. Use of deoxyinosine-containing primers vs degenerate primers for polymerase chain reaction based on ambiguous sequence information. Mol Cell Probes 8(2):91-98 (1994).

Rossy, et al., The integration of signaling and the spatial organization of the T cell synapse. Front Immunol 3:352 (2012).

Roybal et al. Precision Tumor Recognition by T Cells With Combinatorial Antigen-Sensing Circuits. Cell 164:1-10 (2016).

Ruella et al. Smart CARS: optimized development of a chimeric antigen receptor (CAR) T cell targeting epidermal growth factor receptor variant III (EGFRvIII) for glioblastoma. Ann Transl Med 4(1):13 (2016).

Rump et al. Binding of ovarian cancer antigen CA125/MUC16 to mesothelin mediates cell adhesion. J Biol Chem 279:9190-9198 (2004).

Rushworth et al. Universal Artificial Antigen Presenting Cells to Selectively Propagate T Cells Expressing Chimeric Antigen Receptor Independent of Specificity. J Immunother 37(4):204-213 (2014).

Sabbagh, et al., ERK-Dependent Bim Modulation Downstream of the 4-1BB-TRAF1 Signaling Axis Is a Critical Mediator of CD8 T Cell Survival In Vivo. J Immunol 180:8093-8101 (2008).

Sadelain. CAR therapy: The CD19 paradigm. J Clin Invest 135(9):3392-3400 (2015).

Sadelain et al. Tales of Antigen Evasion from CAR Therapy. Cancer Immunol Res 4(6):473 (2016).

Sadelain et al. The basic principles of chimeric antigen receptor design. Cancer Discov. 3(4):388-98 (2013).

Sadelain et al. Therapeutic T cell engineering. Nature 545:423-431 (2017).

Sakemura et al. A Tet-On Inducible System for Controlling CD19-Chimeric Antigen Receptor Expression upon Drug Administration. Cancer Immunol Res 4(8):658-668 (2016).

Sander et al. CRISPR-Cas systems for editing, regulating and targeting genomes. Nat. Biotechnol 32:347-355 (2014).

Sandhu. A rapid procedure for the humanization of monoclonal antibodies. Gene 150(2):409-410 (1994).

Sapede et al. Aberrant splicing and protease involvement in mesothelin release from epithelioid mesothelioma cells. Cancer Sci 99(3):590-594 (2008).

Savoldo, et al., CD28 costimulation improves expansion and persistence of chimeric antigen receptor-modified T cells in lymphoma patients. J Clin Invest 121:1822-1826 (2011).

Schambach, et al., Biosafety Features of Lentiviral Vectors. Human Gene Therapy 24:132-142 (2013).

Schamel, et al., Coexistence of multivalent and monovalent TCRs explains high sensitivity and wide range of response. JEM 202(4):493-503 (2005).

Schenborn et al. A novel transcription property of SP6 and T7 Rna polymerases: dependence on template structure. Nuc Acids Res 13:6223-6236 (1985).

Scheper, et al., Low and variable tumor reactivity of the intratumoral TCR repertoire in human cancers. Nature Medicine 25:89-94 (2019).

Schumacher, et al., T-Cell-Receptor Gene Therapy. Nature 2:512-519 (2002).

(56) References Cited

OTHER PUBLICATIONS

Seder et al. Similarities and differences in CD4+ and CD8+ effector and memory T cell generation. Nat Immunol 4(9):835-842 (2003).
Servais et al. An In Vivo Platform for Tumor Biomarker Assessment. PloS One 6(10):e26772 (2011).
Sharpe et al. Genetically modified T cells in cancer therapy: opportunities and challenges. Dis Model Mech 8(4):337-350 (2015).
Shimabukuro-Vornhagen et al. Cytokine release syndrome. J Immunother Cancer 6:56 (2018).
Shin et al. Positive conversion of negative signaling of CTLA4 potentiates antitumor efficacy of adoptive T-cell therapy in murine tumor models. Blood 119(24):5678-5687 (2012).
Shultz, et al., Humanized mice in translational biomedical research. Nature 7:118-130 (2007).
Simon et al. PD-1 expression conditions T cell avidity within an antigen-specific repertoire. Oncoimmunology 5(1):e1104448 (2015).
Sims et al. A humanized CD18 antibody can block function without cell destruction. J Immunol. 151:2296-2308 (1993).
Smith et al. Comparison of Biosequences. Advances in Applied Mathematics. 2:482-489 (1981).
Soltes, et al. A new helper phage and phagemid vector system improves viral display of antibody Fab fragments and avoids propagation of insert-less voropms. J Immunol Meth 274:233-244 (2003).
Sommermeyer, et al., Chimeric antigen receptor-modified T cells derived from defined CD8+ and CD4+ subsets confer superior antitumor reactivity in vivo. Leukemia 30(2):492-500 (2016).
Sommermeyer et al. Designer T cells by T cell receptor replacement. Eur J Immunol 36(11):3052-3059 (2006).
Sommers et al. Function of CD38-mediated Signals in T Cell Development. J Exper Med 192(6):913-920 (2000).
Song et al. CD27 costimulation augments the survival and antitumor activity of redirected human T cells in vivo. Blood 119(3):696-706 (2012).
Song et al. In Vivo Persistence, Tumor Localization, and Antitumor Activity of CAR-Engineered T Cells Is Enhanced by Costimulatory Signaling through CD137 (4-1BB). Cancer Res 71(13):4617-4627 (2011).
Spear et al. Collaboration of chimeric antigen receptor (CAR)-expressing T cells and host T cells for optimal elimination of established ovarian tumors. Oncoimmunology 2(4):e23564 (2013).
Srivastava et al. Engineering CAR-T cells: Design concepts. Trends Immunol 36(8):494-502 (2015).
Starke et al. Exon circularization requires canonical splice signals. Cell rep 10(1):103-111 (2015).
Stepinski et al. Synthesis and properties of mRNAs containing the novel ‘anti-reverse’ cap analogs 7-methyl(3'0-methyl)GpppG and 7-methyl(e'-deoxy)GpppG. RNA 7:1486-1495 (2001).
Stoddard. Homing endonuclease structure and function. Q. Rev. Biophys. 38:49-95 (2006).
Stone, et al., A sensitivity scale for targeting T cells with chimeric antigen receptors (CARs) and bispecific T-cell engagers (BiTEs). OncoImmunology 1(6):863-873 (2012).
Stromnes et al. T Cells Engineered against a Native Antigen Can Surmount Immunologic and Physical Barriers to Treat Pancreatic Ductal Adenocarcinoma. Cancer Cell 28:638-652 (2015).
Studnicka et al. Human-engineered monoclonal antibodies retain full specific binding activity by preserving non-CDR complementarity-modulating residues. Pro Eng 7(6):805-814 (1994).
Sun et al. The quest for spatio-temporal control of CAR T cells. Cell Res 25(12):1281-1282 (2015).
Swamy, et al., A Cholesterol-Based Allostery Model of T Cell Receptor Phosphorylation. Immunity 44:1091-1101 (2016).
Szabo et al. Detecting circular RNAs: bioinformatic and experimental challenges. Nat Rev Genet 17(11):679-692 (2016).
Szymczak, et al., Correction of multi-gene deficiency in vivo using a single ‘self-cleaving’ 2A peptide-based retroviral vector. Nat Biotechnol 22(5):589-594 (2004).
Tan et al., ‘Superhumanized’ Antibodies: Reduction of Immunogenic Potential by Complementarity-Determining Region Grafting with Human Germline Sequences: Application to an Anti-CD28. J Immunol 169: 1119-1125 (2002).
Tang et al. A human single-domain antibody elicits potent antitumor activity by targeting an epitope in mesothelin close to the cancer cell surface. Mol. Cancer Thera 12(4):416-426 (2013).
Tanyi et al. Possible Compartmental Cytokine Release Syndrome in a Patient With Recurrent Ovarian Cancer After Treatment With Mesothelin-targeted CAR-T Cells. J Immunother 40(3):104-107 (2017).
Tchou et al. Safety and efficacy of intratumoral injections of chimeric antigen receptor (CAR) T cells in metastatic breast cancer. Cancer Immunol Res 5(12):1152-1161 (2017).
TCR2 Therapeutics Presents Positive Solid Tumor Data for its Novel TRuC ™ Engineered T Cell Therapies at the World Preclinical Congress. PRNewswire. Available at http://www.prnewswire.com/news-releases/tcr2-therapeutics-presents-positive-solid-tumor-data-for-its-novel-truc-engineered-t-cell-therapies-at-the-world-preclinical-congress-300472629.html (Jun. 13, 2017) (2 pgs.).
Teachey. Identification of Predictive Biomarkers for Cytokine Release Syndrome after Chimeric Antigen Receptor T cell Therapy for Acute Lymphoblastic Leukemia. Cancer Disc 6(6):664-679 (2016).
Ten Berg et al. Selective expansion of a peripheral blood CD8+ memory T cell subset expressing both granzyme B and L-selectin during primary viral infection in renal allograft recipients. Transplant Proc 30(8):3975-3977 (1998).
Themeli et al. Generation of tumor-targeted human T lymphocytes from induced pluripotent stem cells for cancer therapy. Nat Biotech 31:928-933 (2013).
Themeli et al. New cell sources for T cell engineering and adoptive immunotherapy. Cell Stem Cell 16(4):357-366 (2015).
Thokala et al. Redirecting Specificity of T cells Using the Sleeping Beauty System to Express Chimeric Antigen Receptors by Mix-and-Matching of VLand VHDomains Targeting CD123+ Tumors. PLoS One 11(8):e0159477 (2016).
Topalian et al. Safety, Activity, and Immune Correlates of Anti-PD-1 Antibody in Cancer. N Engl J Med 366:2443-2454 (2012).
Torikai et al. A foundation for universal T-cell based immunotherapy: T cells engineered to express a CD19-specific chimeric-antigen-receptor and eliminate expression of endogenous TCR. Blood 119(24):5697-5705 (2012).
Torikai et al. Translational Implications for Off-the-shelf Immune Cells Expressing Chimeric Antigen Receptors. Mol Ther 24(7):1178-1186 (2016).
Tran et al. Cancer Immunotherapy Based on Mutation-Specific CD4+ T Cells in a Patient with Epithelial Cancer. Science 9:641-645 (2014).
Tsai et al. Producer T cells: Using genetically engineered T cells as vehicles to generate and deliver therapeutics to tumors. Oncoimmunol 5(5):e1122158 (2016).
Tumaini et al. Simplified process for the production of anti-CD19-CAR engineered T cells. Cytotherapy 15(11):1406-1415 (2014).
Turtle et al. CD19 CAR-T cells of defined CD4+:CD8+ composition in adult B cell ALL patients. J Clin Invest 126(6):2123-2138 (2016).
Ui-Tei et al. Sensitive assay of RNA interference in *Drosophila* and Chinese hamster cultured cells using firefly luciferase gene as target. FEBS Letters 479: 79-82 (2000).
Urnov et al. Genome editing with engineered zinc finger nucleases. Nature Reviews Genetics 11:636-646 (2010).
U.S. Appl. No. 15/419,398 1st Action Interview dated Jul. 3, 2017.
U.S. Appl. No. 15/419,398 Office Action dated Jul. 17, 2019.
U.S. Appl. No. 15/419,398 Office Action dated Mar. 7, 2018.
U.S. Appl. No. 15/419,398 Office Action dated May 24, 2019.
U.S. Appl. No. 15/419,398 Office Action dated Nov. 9, 2017.
U.S. Appl. No. 15/965,738 Preinterview First Action dated Nov. 15, 2018.
U.S. Appl. No. 15/965,739 Preinterview First Action dated Nov. 15, 2018.
U.S. Appl. No. 16/436,110 Office Action dated Jul. 15, 2022.
Valton et al. A Multidrug-resistant Engineered CAR T Cell for Allogeneic Combination Immunotherapy. Mol Ther 23(9):1507-1518 (2015).

(56) References Cited

OTHER PUBLICATIONS

Van Der Stegen et al. The pharmacology of second-generation chimeric antigen receptors. Nat Rev Drug Discov 14(7):499-509 (2015).
Velasquez. T cells expressing CD19-specific Engager Molecules for the Immunotherapy of CD19-positive Malignancies. Sci Rep 6:27130 (2016).
Verhoeyen et al. Reshaping human antibodies: grafting an antilysozyme activity. Science 239:1534-1536 (1988).
Verma et al., TCR Mimic Monoclonal Antibody Targets a Specific Peptide/HLA Class I Complex and Significantly Impedes Tumor Growth In Vivo Using Breast Cancer Model. J Immunol 184:2156-2165 (2010).
Vermeire et al. Signal peptide-binding drug as a selective inhibitor of co-translational protein translocation. PLoOS Biol 12(12):e1002011 (2014).
Wang, et al., 2A self-cleaving peptide-based multi-gene expression system in the silkworm *Bombyx mori*. Nature 5:16273 (2015).
Wang et al. Generation of Potent T-cell Immunotherapy for Cancer Using DAP12-Based, Multichain, Chimeric Immunoreceptors. Cancer Immunol Res 3(7):815-826 (2015).
Wang et al. Manufacture of tumor- and virus-specific T lymphocytes for adoptive cell therapies. Cancer Gene Therapy 22(2):85-94 (2015).
Wang et al. VISTA, a novel mouse Ig superfamily ligand that negatively regulates T cell responses. J Exp Med 208(3):577-592 (2011).
Watanabe et al. Fine-tuning the CAR spacer improves T-cell potency. Oncoimmunology. 5(2):e1253656 (2016).
Weekes et al. Phase I Study of DMOT4039A, an Antibody-Drug Conjugate Targeting Mesothelin, in Patients with Unresectable Pancreatic or Platinum-Resistant Ovarian Cancer. Mol Cancer Ther 15(3):439-447 (2016).
Wegener et al. The T cell receptor/CD3 complex is composed of at least two autonomous transduction modules. Cell 68:83-95 (1992).
Weinmann., Corrigendum: Cancer Immunotherapy: Selected Targets and Small-Molecule Modulators. Chem Med Chem 14:1576 (2016).
Whittington et al. Accounting for All Costs in the Total Cost of Chimeric Antigen Receptor T-Cell Immunotherapy. JAMA Oncol. Published online Oct. 11, 2018 (1 pg.).
Wilkie et al. Selective Expansion of Chimeric Antigen Receptor-targeted T-cells with Potent Effector Function using Interleukin-4. J Biol Chem 285(33):25538-25544 (2010).
Wittman, et al., Antibody Targeting to a Class I MHC-Peptide Epitope Promotes Tumor Cell Death. J Immunol 177:4187-4195 (2006).
Wucherpfennig et al. Structural Biology of the T-cell Receptor: Insights into Receptor Assembly, Ligand Recognition, and Initiation of Signaling. Cold Spring Harb Perspect Biol 2(4):a005140 (2010).
Yanez et al., CAR T Cell Toxicity: Current Management and Future Directions. HemaSphere 3(2):e186 (2019).
Yang, et al., TCR engagement negatively affects CD8 but CD4 CAR T cell expansion and leukemic clearance. Sci Transl Med 9(417):eaag1209 (2017).
Yao, et al., Advances in targeting cell surface signalling molecules for immune modulation. Nat Rev Drug Discov. 12(2):130-146 (2013).
Yokosuka et al. Programmed cell death 1 forms negative costimulatory microclusters that directly inhibit T cell receptor signaling by recruiting phosphatase SHP2. J Exp Med 209(6):1201-1217 (2012).
Yu et al. CD28 ligation induces transplantation tolerance by IFN-gamma-dependent depletion of T cells that recognize alloantigens. J Clin Invest 113:1624-1630 (2004).
Yu et al. CD28 signal enhances apoptosis of CD8 T cells after strong TCR ligation. J Immunol 170:3002-3006 (2003).
Yun et al. Targeting of T Lymphocytes to Melanoma Cells Through Chimeric Anti-GD3 Immunoglobulin T-Cell Receptors. Neoplasia 2(5):449-459 (2000).
Zah et al. T cells expressing CD19/CD20 bi-specific chimeric antigen receptors prevent antigen escape by malignant B cells. Cancer Immunol Res 4(6)498-509 (2016).
Zenz. Exhausting T cells in CLL. Blood 121(9):1485-1487 (2013).
Zhang et al. 4-1BB is superior to CD28 costimulation for generating CD8+ cytotoxic lymphocytes for adoptive immunotherapy. J Immunol 179:4910-4918 (2007).
Zhang, et al An NKp30-Based Chimeric Antigen Receptor Promotes T cell Effector Functions and Antitumor Efficacy In Vivo. J. Immunol 189(5):2290-2299 (2012).
Zhang, et al., Chimeric NK-receptor-bearing T cells mediate antitumor immunotherapy. Blood 106(5):1544-1552 (2005).
Zhang, et al., Efficiency of CD19 chimeric antigen receptor-modified T cells for treatment of B cell malignancies in phase I clinical trials: a meta-analysis. Oncotarget 6(32):33961 (2015).
Zhang, et al., New Strategies for the Treatment of Solid Tumors with CAR-T Cells. Int J Biol Sci 12:718-729 (2016).
Zhang et al. Phase I Escalating-Dose Trial of CAR-T Therapy Targeting CEA+ Metastatic Colorectal Cancers. Mol Ther 25:1248-1258 (2017).
Zhao et al. A herceptin-based chimeric antigen receptor with modified signaling domains leads to enhanced survival of transduced T lymphocytes and antitumor activity. J Immunol 183:5563-5574 (2009).
Zhao et al. Multiple injections of electroporated autologous T cells expressing a chimeric antigen receptor mediate regression of human disseminated tumor. Cancer Res 70(22):9053-9061 w/Supplemental Information (2010).
Zhao et al. Structural Design of Engineered Costimulation Determines Tumor Rejection Kinetics and Persistence of CAR T cells. Cancer Cell 28(4):415-428 (2015).
Zheng, et al., All Human EFI a Promoters Are Not Equal: Markedly Affect Gene Expression in Constructs from Different Sources. Int J Med Sci 11(5):404-408 (2014).
Goverman et al. Chimeric immunoglobulin-T cell receptor proteins form functional receptors: implications for T cell receptor complex formation and activation. Cell 60(6):929-939 (1990).
Gross et al. Endowing T cells with antibody specificity using chimeric T cell receptors. FASEB J. 6(15):3370-3378 (1992).
Moeller et al. Sustained antigen-specific antitumor recall response mediated by gene-modified CD4+ T helper-1 and CD8+ T cells. Cancer Res 67(23):11428-11437 (2007).
PCT/US2021/030973 International Search Report and Written Opinion dated Oct. 27, 2021.
PCT/US2023/024139 International Search Report and Written Opinion dated Sep. 25, 2023.
T-cell receptor From Wikipedia, the free encyclopedia; ; p. 1-6; downloaded Dec. 2, 2021.
UniProtKB CD3E_HUMAN P07766. Apr. 29, 2015, pp. 1-6 (2015).
U.S. Appl. No. 18/069,749 Office Action dated Aug. 29, 2023.
Szabo et al. Statistically based splicing detection reveals neural enrichment and tissue-specific induction of circular RNA during human fetal development. Genome Biol 16(1):126 (2015).

* cited by examiner

Octet Binding Assay

| Binder | $K_D$ (nM) | $k_{on}$ ($s^{-1}$) | $k_{off}$ ($M^{-1}s^{-1}$) |
|---|---|---|---|
| **CD27-Fc** | 1.7 | $3.9 \times 10^{6}$ | $6.6 \times 10^{-3}$ |
| **41D12 (LwH)** | $1.0 \times 10^{-3}$ | $1.7 \times 10^{8}$ | $1.3 \times 10^{-5}$ |
| **Anti-HEL (Neg)** | ND | - | - |
| **R3P3H12** | $1.6 \times 10^{-1}$ | $6.5 \times 10^{7}$ | $1.0 \times 10^{-2}$ |
| **R3P5A1** | $2.5.\ 10^{-2}$ | $2.5 \times 10^{8}$ | $6.1 \times 10^{-3}$ |
| **R3aP3E8** | $2.7 \times 10^{-2}$ | $3.6 \times 10^{8}$ | $9.8 \times 10^{-3}$ |
| **R3aP9D10** | $3.6 \times 10^{-2}$ | $2.2 \times 10^{8}$ | $7.8 \times 10^{-3}$ |

Epitope binning

| | | Ab2 | | | | | | |
|---|---|---|---|---|---|---|---|---|
| | | 1F6 | 41D12 | CD27Fc | R3AP3E8 | R3AP9D10 | R3P3H12 | R3P5A1 |
| Ab1 | 1F6 | 0.09 | 0.14 | 0.11 | -0.01 | 0.02 | 0.06 | 0.00 |
| | 41D12 | 0.06 | 0.03 | 0.02 | 0.03 | 0.03 | 0.03 | 0.04 |
| | CD27Fc | 0.54 | 0.54 | 0.08 | 0.26 | 0.24 | 0.20 | 0.28 |
| | R3AP3E8 | 0.23 | 0.23 | 0.06 | 0.05 | 0.06 | 0.05 | 0.07 |
| | R3AP9D10 | 0.28 | 0.31 | 0.06 | 0.09 | 0.04 | 0.06 | 0.09 |
| | R3P3H12 | 0.59 | 0.56 | 0.24 | 0.24 | 0.16 | 0.03 | 0.21 |
| | R3P5A1 | 0.27 | 0.27 | 0.08 | 0.09 | 0.07 | 0.06 | 0.05 |

FROM FIG. 7A-1

FROM FIG. 8A-1

TO FIG. 9D-3

FROM FIG. 9D-1

Memory Phenotype

Generation of Jurkat WT and CD3e KO 70-001 TRuCs

TO FIG. 30D

FROM FIG. 30A

TO FIG. 32B 70-001 and 1F6 hFc fusions block target cell-dependent induction of CD69 in 70-001 TRuCs

*1:1 E:T co-culture, 16 hours

Steady-state titration of CD70 with αCD70 scFvs

| Binder | $K_D$ (nM) |
|---|---|
| 1867-His | 56.7 ± 4.4 |
| 1985-His | 55.7 ± 6.8 |
| 1885-His | 41.7 ± 5.5 |

αCD70 ligand, VHH, and scFv epitope binning $K_D$ 100 nM 1 pM

| | | Antibody 2 | | | | | | |
|---|---|---|---|---|---|---|---|---|
| | | 1867-His | 70-001-His | 1985-His | P3H12-His | CD27-His | 1885-His | 41d12-His |
| Antibody 1 | 1867-His | 0.03 | 0.01 | 0.01 | -0.02 | 0.02 | 0.46 | 0.15 |
| | 70-001-His | 0.11 | 0.01 | 0.04 | 0.03 | 0.04 | 0.69 | 0.22 |
| | 1985-His | 0.15 | 0.04 | 0.02 | 0.01 | 0.10 | 0.74 | 0.22 |
| | P3H12-His | 0.34 | 0.10 | 0.09 | 0.03 | 0.16 | 1.01 | 0.49 |
| | CD27-His | 0.28 | 0.06 | 0.10 | 0.07 | 0.03 | 0.85 | 0.40 |
| | 1885-His | -0.08 | -0.12 | -0.08 | -0.10 | -0.08 | 0.07 | 0.45 |
| | 41d12-His | 0.03 | -0.02 | 0.02 | 0.01 | -0.01 | -0.02 | 0.04 |

*Arrows show direction of displacement

| Binder | $K_D$ (nM) |
|---|---|
| 1867-His | 56.7 ± 4.4 |
| 70-001-His | 7.9 ± 1.3 |
| 1985-His | 55.7 ± 6.8 |
| P3H12-His | 26.2 ± 7.5 |
| CD27-His | 129.8 ± 18.9 |
| 1885-His | 41.7 ± 5.5 |

Comparison of αCD70 Binders

Binning Network

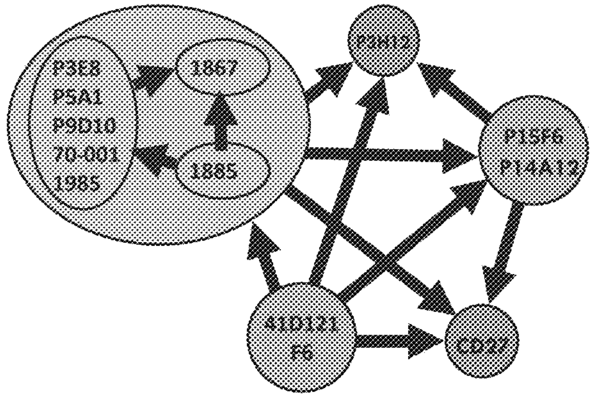

Binning Network Representation

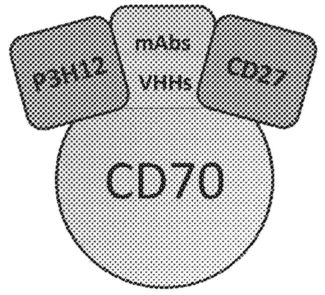

| | Type | $K_D$ (nM) | CD27 blocking | Epitope |
|---|---|---|---|---|
| 41D12 | scFv | 0.02-0.34 | Yes | HRDGIYMVHIQVTLAICSSTTAS |
| 1885 | scFv | 41.7 | Yes | HRDGIYMVHIQVTLAICSSTTAS |
| 1985 | scFv | 55.7 | Yes | HRDGIYMVHIQVTLAICSSTTAS |
| C10 (1867) | scFv | 56.7 | Yes | HRDGIYMVHIQVTLAICSSTTAS<br>ASRHHPTTLAVGICSPASRSISL |
| 70-001 | VHH | 4.1 | Yes | HRDGIYMVHIQVTLAICSSTTAS |
| P15F6 | VHH | 11.6 | Yes | HRDGIYMVHIQVTLAICSSTTAS |
| P3E8 | VHH | 8.3 | Yes | HRDGIYMVHIQVTLAICSSTTAS |
| P5A1 | VHH | 4.9 | Yes | HRDGIYMVHIQVTLAICSSTTAS |
| P3H12 | VHH | 19.5 | No | HRDGIYMVHIQVTLAICSSTTAS |
| CD27Fc | Rec | 27.1 | Yes | HRDGIYMVHIQVTLAICSSTTAS |

FIG. 37C

FROM FIG. 39A-1

FROM FIG. 39B-1

TO FIG. 39B-4

| | Fratricide-free (non-CD70 targeting TRuC) | Fratricide-prone (CD70 targeting TRuC) | CD70-sepcifc TRuC candidates | | | | | | | | | |
|---|---|---|---|---|---|---|---|---|---|---|---|---|
| | | | #1 | #2 | #3 | #4 | #5 | #6 | #7 | #8 | #9 | #10 |
| Expansion | Normal | Low | * | * | * | x | x | x | x | * | x | x |
| TRuC expression | High | High | * | * | * | * | * | * | * | * | * | * |
| Activation | Low | High | * | x | * | x | x | x | x | * | x | * |
| Differentiation | High Naïve<br>Low TEMRA | Low Naïve<br>High TEMRA | * | x | * | x | * | x | x | * | x | * |

FIG. 46

FROM FIG. 51A

FROM FIG. 52A

FROM FIG. 53B

24-hours Cytokine Production

R018

K562, CD70 negative
THP-1, ACHN, MOLM-1, CD70 moderate
786-O, CD70 high

FROM

FROM FIG. 70A-1

CD70 TRuCs Result in 786-0 Tumor Regression

Raji Tumor Efficacy

COMPOSITIONS AND METHODS FOR TCR REPROGRAMMING USING CD70 SPECIFIC FUSION PROTEINS

CROSS-REFERENCE

This application claims the benefit of U.S. Provisional Patent Application No. 63/020,196, filed May 5, 2020, U.S. Provisional Application No. 63/129,718, filed Dec. 23, 2020, U.S. Provisional Application No. 63/147,618, filed Feb. 9, 2021, and U.S. Provisional Application No. 63/171,751, filed Apr. 7, 2021, each of which is incorporated herein by reference in its entirety.

FIELD

The present invention is directed to a novel therapeutics and method for treating CD70-related diseases and disorders.

BACKGROUND

Human cancers are by their nature comprised of normal cells that have undergone a genetic or epigenetic conversion to become abnormal cancer cells. In doing so, cancer cells begin to express proteins and other antigens that are distinct from those expressed by normal cells. These aberrant tumor antigens can be used by the body's innate immune system to specifically target and kill cancer cells. However, cancer cells employ various mechanisms to prevent immune cells, such as T and B lymphocytes, from successfully targeting cancer cells.

Most patients with late-stage solid tumors are incurable with standard therapy. In addition, traditional treatment options often have serious side effects. Numerous attempts have been made to engage a patient's immune system for rejecting cancerous cells, an approach collectively referred to as cancer immunotherapy. However, several obstacles make it rather difficult to achieve clinical effectiveness. Although hundreds of so-called tumor antigens have been identified, these are often derived from self and thus can direct the cancer immunotherapy against healthy tissue, or are poorly immunogenic. Furthermore, cancer cells use multiple mechanisms to render themselves invisible or hostile to the initiation and propagation of an immune attack by cancer immunotherapies.

Human T cell therapies rely on enriched or modified human T cells to target and kill cancer cells in a patient. To increase the ability of T cells to target and kill a particular cancer cell, methods have been developed to engineer T cells to express constructs which direct T cells to a particular target cancer cell. Chimeric antigen receptors (CARs) and engineered T cell receptors (TCRs), which comprise binding domains capable of interacting with a particular tumor antigen, allow T cells to target and kill cancer cells that express the particular tumor antigen.

Besides the ability of genetically modified T cells expressing a CAR or an engineered TCR to recognize and destroy respective target cells in vitro/ex vivo, successful patient therapy with engineered T cells requires the T cells to be capable of strong activation, expansion, persistence over time, effective tumor targeting, reduced and, in case of relapsing disease, to enable a 'memory' response. In addition, CAR therapies currently being developed have been associated with the release of high levels of pro-inflammatory cytokines that have been associated with dose-limiting toxicities.

SUMMARY

There is a clear need to develop improved genetically engineered T cells to act against various human malignancies, including CD70 expressing malignancies. Described herein are novel fusion proteins of TCR subunits, including CD3 epsilon, CD3 gamma and CD3 delta, and of TCR alpha and TCR beta chains with binding domains specific to CD70 that have the potential to overcome limitations of existing approaches.

Provided herein are recombinant nucleic acid molecules comprising a sequence encoding a T cell receptor (TCR) fusion protein (TFP) wherein the TFP comprises: (a) a TCR subunit comprising: (i) at least a portion of a TCR extracellular domain, and (ii) a TCR transmembrane domain, (iii) a TCR intracellular domain, and (b) an antigen binding domain that specifically binds CD70; and wherein the TCR subunit and the antigen binding domain are operatively linked.

In some embodiments, the TFP functionally interacts with an endogenous TCR complex when expressed in a T cell.

In some embodiments, the TCR intracellular domain comprises a stimulatory domain from an intracellular signaling domain of CD3 gamma, CD3 delta, or CD3 epsilon.

In some embodiments, a T cell expressing the TFP exhibits increased cytotoxicity to a human cell expressing CD70 compared to a T cell not containing the TFP.

In some embodiments, the antigen binding domain is connected to the TCR extracellular domain by a linker sequence.

In some embodiments, the linker is 120 amino acids in length or less.

In some embodiments, the linker sequence comprises $(G_4S)_n$, wherein G is glycine, S is serine, and n is an integer from 1 to 10.

In some embodiments, n is an integer from 1 to 4.

In some embodiments, at least two of the TCR extracellular domain, the TCR transmembrane domain, and the TCR intracellular domain are from the same TCR subunit.

In some embodiments, at least two of the TCR extracellular domain, the TCR transmembrane domain, and the TCR intracellular domain are from TCR alpha.

In some embodiments, at least two of the TCR extracellular domain, the TCR transmembrane domain, and the TCR intracellular domain are from TCR beta.

In some embodiments, at least two of the TCR extracellular domain, the TCR transmembrane domain, and the TCR intracellular domain are from TCR gamma.

In some embodiments, at least two of the TCR extracellular domain, the TCR transmembrane domain, and the TCR intracellular domain are from TCR delta.

In some embodiments, at least two of the TCR extracellular domain, the TCR transmembrane domain, and the TCR intracellular domain are from CD3 epsilon.

In some embodiments, at least two of the TCR extracellular domain, the TCR transmembrane domain, and the TCR intracellular domain are from CD3 delta.

In some embodiments, at least two of the TCR extracellular domain, the TCR transmembrane domain, and the TCR intracellular domain are from CD3 gamma.

In some embodiments, all three of the TCR extracellular domain, the TCR transmembrane domain, and the TCR intracellular domain are from the same TCR subunit.

In some embodiments, the TCR extracellular domain, the TCR transmembrane domain, and the TCR intracellular domain are from CD3 epsilon.

In some embodiments, the TCR extracellular domain, the TCR transmembrane domain, and the TCR intracellular domain are from CD3 delta.

In some embodiments, the TCR extracellular domain, the TCR transmembrane domain, and the TCR intracellular domain are from CD3 gamma.

In some embodiments, the TCR extracellular domain, the TCR transmembrane domain, and the TCR intracellular domain comprise the constant domain of TCR alpha.

In some embodiments, the constant domain of TCR alpha is murine.

In some embodiments, the TCR extracellular domain, the TCR transmembrane domain, and the TCR intracellular domain comprise the constant domain of TCR beta.

In some embodiments, the constant domain of TCR beta is murine.

In some embodiments, the TCR extracellular domain, the TCR transmembrane domain, and the TCR intracellular domain comprise the constant domain of TCR gamma.

In some embodiments, the TCR extracellular domain, the TCR transmembrane domain, and the TCR intracellular domain comprise the constant domain of TCR delta.

In some embodiments, the antigen binding domain is a camelid antibody or binding fragment thereof.

In some embodiments, the antigen binding domain is a murine antibody or binding fragment thereof.

In some embodiments, the antigen binding domain is a human or humanized antibody or binding fragment thereof.

In some embodiments, the antigen binding domain is a single-chain variable fragment (scFv) or a single domain antibody (sdAb) domain.

In some embodiments, the antigen binding domain is a single domain antibody (sdAb).

In some embodiments, the sdAb is a $V_{HH}$.

In some embodiments, the antigen binding domain binds to human CD70 with a $K_D$ value of 100 nM or less or from about 0.001 nM to about 100 nM.

In some embodiments, the antigen binding domain does not compete with CD27 for binding to CD70, does not inhibit CD70 from interacting with CD27, and/or does not bind to the same epitope of CD70 to which CD27 binds.

In some embodiments, the antigen binding domain competes with CD27 for binding to CD70, inhibits CD70 from interacting with CD27, and/or binds to the same epitope of CD70 to which CD27 binds.

In some embodiments, the antigen binding domain specifically binds to an epitope that is within the amino acid sequence HRDGIYMVHIQVTLAICSSTTAS (SEQ ID NO:1230).

In some embodiments, the antigen binding domain comprises a scFv having at least about 90% sequence identity to any one of sequence of SEQ ID NOs: 1207-1222, 1246, and 1247.

In some embodiments, the antigen binding domain comprises a sdAb domain having at least about 90% sequence identity to any one of sequence of SEQ ID NOs: 1223-1227.

In some embodiments, the antigen binding domain comprises a variable domain comprising a complementarity determining region 1 (CDR1), a CDR2, and a CDR3.

In some embodiments, the antigen binding domain comprises a variable domain having at least 90% sequence identity to any one of SEQ ID NOs: 603-620 and 622-688.

In some embodiments, (i) CDR1 comprises a sequence of any one of SEQ ID NOs: 87-104 and 107-172; (ii) CDR2 comprises a sequence of any one of SEQ ID NOs: 259-276 and 279-344; and (iii) CDR3 comprises a sequence of any one of SEQ ID NOs: 431-448 and 451-516.

In some embodiments, the antigen binding domain comprises a variable domain having at least 90% sequence identity to SEQ ID NO: 618.

In some embodiments, the variable domain has at least 95% sequence identity to SEQ ID NO: 618.

In some embodiments, the variable domain comprises the sequence of SEQ ID NOs: 618.

In some embodiments, CDR1 is SEQ ID NO: 102, CDR2 is SEQ ID NO: 274 and CDR3 is SEQ ID NO: 446.

In some embodiments, the antigen binding domain comprises a sdAb domain having at least about 90% sequence identity to any one of sequence of SEQ ID NOs: 1224-1227.

In some embodiments, the antigen binding domain is a single-chain variable fragment (scFv).

In some embodiments, the scFv comprises a heavy chain variable (VH) domain having at least 90% sequence identity to any one of SEQ ID NOs: 783-835.

In some embodiments, the scFv comprises a heavy chain variable (VH) domain having at least 95% sequence identity to any one of SEQ ID NOs: 783-835.

In some embodiments, the scFv comprises a heavy chain variable (VH) domain having a sequence of any one of SEQ ID NOs: 783-835.

In some embodiments, the scFv comprises a light chain variable (VL) domain having at least 90% sequence identity to any one of SEQ ID NOs: 995-1047.

In some embodiments, the scFv comprises a light chain variable (VL) domain having at least 95% sequence identity to any one of SEQ ID NOs: 995-1047.

In some embodiments, the scFv comprises a light chain variable (VL) domain having a sequence of any one of SEQ ID NOs: 995-1047.

In some embodiments, the VH domain comprises a heavy chain complementary determining region 1 (CDRH1) having a sequence of any one of SEQ ID NOs: 836-888, a CDRH2 having a sequence of any one of SEQ ID NOs: 889-941, and a CDRH3 having a sequence of any one of SEQ ID NOs: 942-994.

In some embodiments, the VL domain comprises a light chain complementary determining region 1 (CDRL1) having a sequence of any one of SEQ ID NOs: 1048-1100, a CDRL2 having a sequence of any one of SEQ ID NOs: 1101-1153, and a CDRL3 having a sequence of any one of SEQ ID NOs: 1154-1206.

In some embodiments, the scFv comprises a VH domain having at least 90% sequence identity to SEQ ID NO: 1248.

In some embodiments, the scFv comprises a VH domain of the sequence of SEQ ID NO: 1248.

In some embodiments, the scFv comprises a VL domain having at least 90% sequence identity to SEQ ID NO: 1249.

In some embodiments, the scFv comprises a VL domain of the sequence of SEQ ID NO: 1249.

In some embodiments, the scFv comprises a VH domain having at least 90% sequence identity to SEQ ID NO: 1248, and a VL domain having at least 90% sequence identity to SEQ ID NO: 1249.

In some embodiments, the scFv comprises a VH domain of the sequence of SEQ ID NO: 1248, and a VL domain of the sequence of SEQ ID NO: 1249.

In some embodiments, the VH domain of the sequence of SEQ ID NO: 1248 is operably linked via its C-terminus to the N-terminus of the VL domain of the sequence of SEQ ID NO: 1249.

In some embodiments, the VL domain of the sequence of SEQ ID NO: 1249 is operably linked via its C-terminus to the N-terminus of the VH domain of the sequence of SEQ ID NO: 1248.

In some embodiments, the scFv comprises a linker sequence of SEQ ID NO: 1237.

In some embodiments, the VH of the sequence of SEQ ID NO: 1248 and the VL domain of the sequence of SEQ ID NO: 1249 are operably linked via a linker sequence of SEQ ID NO: 1237.

In some embodiments, the scFv comprises a sequence having at least 90% sequence identity to SEQ ID NO: 1207 or SEQ ID NO: 1208.

In some embodiments, the scFv comprises the sequence of SEQ ID NO: 1207 or SEQ ID NO: 1208.

In some embodiments, the scFv comprises a VH domain having at least 90% sequence identity to SEQ ID NO: 1250.

In some embodiments, the scFv comprises a VH domain of the sequence of SEQ ID NO: 1250.

In some embodiments, the scFv comprises a VL domain having at least 90% sequence identity to SEQ ID NO: 1251.

In some embodiments, the scFv comprises a VL domain of the sequence of SEQ ID NO: 1251.

In some embodiments, the scFv comprises a VH domain having at least 90% sequence identity to SEQ ID NO: 1250, and a VL domain having at least 90% sequence identity to SEQ ID NO: 1251.

In some embodiments, the scFv comprises a VH domain of the sequence of SEQ ID NO: 1250, and a VL domain of the sequence of SEQ ID NO: 1251.

In some embodiments, the VH domain of the sequence of SEQ ID NO: 1250 is operably linked via its C-terminus to the N-terminus of the VL domain of the sequence of SEQ ID NO: 1251.

In some embodiments, the VL domain of the sequence of SEQ ID NO: 1251 is operably linked via its C-terminus to the N-terminus of the VH domain of the sequence of SEQ ID NO: 1250.

In some embodiments, the scFv comprises a linker sequence of SEQ ID NO: 1237.

In some embodiments, the VH of the sequence of SEQ ID NO: 1250 and the VL domain of the sequence of SEQ ID NO: 1251 are operably linked via a linker sequence of SEQ ID NO: 1237.

In some embodiments, the scFv comprises a sequence having at least 90% sequence identity to SEQ ID NO: 1209 or SEQ ID NO: 1210.

In some embodiments, the scFv comprises the sequence of SEQ ID NO: 1209 or SEQ ID NO: 1210.

In some embodiments, the scFv comprises a VH domain having at least 90% sequence identity to SEQ ID NO: 1252.

In some embodiments, the scFv comprises a VH domain of the sequence of SEQ ID NO: 1252.

In some embodiments, the scFv comprises a VL domain having at least 90% sequence identity to SEQ ID NO: 1253.

In some embodiments, the scFv comprises a VL domain of the sequence of SEQ ID NO: 1253.

In some embodiments, the scFv comprises a VH domain having at least 90% sequence identity to SEQ ID NO: 1252, and a VL domain having at least 90% sequence identity to SEQ ID NO: 1253.

In some embodiments, the scFv comprises a VH domain of the sequence of SEQ ID NO: 1252, and a VL domain of the sequence of SEQ ID NO: 1253.

In some embodiments, the VH domain of the sequence of SEQ ID NO: 1252 is operably linked via its C-terminus to the N-terminus of the VL domain of the sequence of SEQ ID NO: 1253.

In some embodiments, the VL domain of the sequence of SEQ ID NO: 1253 is operably linked via its C-terminus to the N-terminus of the VH domain of the sequence of SEQ ID NO: 1252.

In some embodiments, the scFv comprises a linker sequence of SEQ ID NO: 1237.

In some embodiments, the VH of the sequence of SEQ ID NO: 1252 and the VL domain of the sequence of SEQ ID NO: 1253 are operably linked via a linker sequence of SEQ ID NO: 1237.

In some embodiments, the scFv comprises a sequence having at least 90% sequence identity to SEQ ID NO: 1246 or SEQ ID NO: 1247.

In some embodiments, the scFv comprises the sequence of SEQ ID NO: 1246 or SEQ ID NO: 1247.

In some embodiments, the antigen binding domain specifically binds to a second epitope is within the amino acid sequence ASRHHPTTLAVGICSPASRSISL (SEQ ID NO:1231).

In some embodiments, the scFv comprises a VH domain that comprises a CDRH1 of SEQ ID NO: 853, a CDRH2 of SEQ ID NO: 906, and a CDRH3 of SEQ ID NO: 959, and a VL domain that comprises a CDRL1 of SEQ ID NO: 1065, a CDRL2 of SEQ ID NO: 1118, and a CDRL3 of SEQ ID NO: 1171.

In some embodiments, the scFv comprises a VH domain having at least 90% sequence identity to SEQ ID NO: 800.

In some embodiments, the scFv comprises a VH domain of the sequence of SEQ ID NO: 800.

In some embodiments, the scFv comprises a VL domain having at least 90% sequence identity to SEQ ID NO: 1012.

In some embodiments, the scFv comprises a VL domain of the sequence of SEQ ID NO: 1012.

In some embodiments, the scFv comprises a VH domain having at least 90% sequence identity to SEQ ID NO: 800, and a VL domain having at least 90% sequence identity to SEQ ID NO: 1012.

In some embodiments, the scFv comprises a VH domain of the sequence of SEQ ID NO: 800, and a VL domain of the sequence of SEQ ID NO: 1012.

In some embodiments, the scFv comprises a linker sequence of SEQ ID NO: 782.

In some embodiments, a T cell expressing the TFP inhibits tumor growth when expressed in a T cell.

In some embodiments, a T cell expressing the TFP has increased fratricide relative to a TFP having a different antigen binding domain.

In some embodiments, a T cell expressing the TFP has decreased fratricide relative to a TFP having a different antigen binding domain.

In some embodiments, the recombinant nucleic acid molecule encodes any one of the amino acid sequences selected from SEQ ID NOs: 1233, 1236, 1240, and 1264.

In an aspect, the present disclosure provide recombinant nucleic acid molecules comprising a sequence encoding an antibody or a fragment thereof that specifically binds CD70.

In some embodiments, the antibody or antibody fragment is a camelid antibody or binding fragment thereof.

In some embodiments, the antibody or antibody fragment is a murine, human or humanized antibody or binding fragment thereof.

In some embodiments, the antibody or antibody fragment is a single-chain variable fragment (scFv) or a single domain antibody (sdAb) domain.

In some embodiments, the antibody or antibody fragment is a single domain antibody (sdAb).

In some embodiments, the sdAb is a $V_{HH}$.

In some embodiments, the antibody or antibody fragment binds to human CD70 with a $K_D$ value of 100 nM or less or from about 0.001 nM to about 100 nM.

In some embodiments, the antibody or antibody fragment does not compete with CD27 for binding to CD70, does not inhibit CD70 from interacting with CD27, and/or does not bind to the same epitope of CD70 to which CD27 binds.

In some embodiments, the antibody or antibody fragment competes with CD27 for binding to CD70, inhibits CD70 from interacting with CD27, and/or binds to the same epitope of CD70 to which CD27 binds.

In some embodiments, the antigen binding domain specifically binds to an epitope that is within the amino acid sequence HRDGIYMVHIQVTLAICSSTTAS (SEQ ID NO:1230).

In some embodiments, the antibody or antibody fragment comprises a scFv having at least about 90% sequence identity to any one of sequence of SEQ ID NOs: 1207-1222, 1246, and 1247.

In some embodiments, the antibody or antibody fragment comprises a sdAb domain having at least about 90% sequence identity to any one of sequence of SEQ ID NOs: 1223-1227.

In some embodiments, the antibody or antibody fragment comprises a variable domain comprising a CDR1, a CDR2, and a CDR3.

In some embodiments, the antibody or antibody fragment comprises a variable domain having at least 90% sequence identity to any one of SEQ ID NOs: 603-620 and 622-688.

In some embodiments, (i) CDR1 comprises a sequence of any one of SEQ ID NOs: 87-104 and 107-172; (ii) CDR2 comprises a sequence of any one of SEQ ID NOs: 259-276 and 279-344; and (iii) CDR3 comprises a sequence of any one of SEQ ID NOs: 431-448 and 451-516.

In some embodiments, the antibody or antibody fragment comprises a variable domain having at least 90% sequence identity to SEQ ID NO: 618.

In some embodiments, the variable domain has at least 95% sequence identity to SEQ ID NO: 618.

In some embodiments, the variable domain comprises the sequence of SEQ ID NOs: 618.

In some embodiments, CDR1 is SEQ ID NO: 102, CDR2 is SEQ ID NO: 274 and CDR3 is SEQ ID NO: 446.

In some embodiments, the antibody or antibody fragment comprises a sdAb domain having at least about 80% sequence identity to any one of sequence of SEQ ID NOs: 1224-1227.

In some embodiments, the antibody or antibody fragment is a scFv.

In some embodiments, the scFv comprises a heavy chain variable (VH) domain having at least 90% sequence identity to any one of SEQ ID NOs: 783-835.

In some embodiments, the scFv comprises a heavy chain variable (VH) domain having at least 95% sequence identity to any one of SEQ ID NOs: 783-835.

In some embodiments, the scFv comprises a heavy chain variable (VH) domain having a sequence of any one of SEQ ID NOs: 783-835.

In some embodiments, the scFv comprises a light chain variable (VL) domain having at least 90% sequence identity to any one of SEQ ID NOs: 995-1047.

In some embodiments, the scFv comprises a light chain variable (VL) domain having at least 95% sequence identity to any one of SEQ ID NOs: 995-1047.

In some embodiments, the scFv comprises a light chain variable (VL) domain having a sequence of any one of SEQ ID NOs: 995-1047.

In some embodiments, the VH domain comprises a CDRH1 having a sequence of any one of SEQ ID NOs: 836-888, a CDRH2 having a sequence of any one of SEQ ID NOs: 889-941, and a CDRH3 having a sequence of any one of SEQ ID NOs: 942-994.

In some embodiments, the VL domain comprises a CDRL1 having a sequence of any one of SEQ ID NOs: 1048-1100, a CDRL2 having a sequence of any one of SEQ ID NOs: 1101-1153, and a CDRL3 having a sequence of any one of SEQ ID NOs: 1154-1206.

In some embodiments, the scFv comprises a VH domain having at least 90% sequence identity to SEQ ID NO: 1248.

In some embodiments, the scFv comprises a VH domain of the sequence of SEQ ID NO: 1248.

In some embodiments, the scFv comprises a VL domain having at least 90% sequence identity to SEQ ID NO: 1249.

In some embodiments, the scFv comprises a VL domain of the sequence of SEQ ID NO: 1249.

In some embodiments, the scFv comprises a VH domain having at least 90% sequence identity to SEQ ID NO: 1248, and a VL domain having at least 90% sequence identity to SEQ ID NO: 1249.

In some embodiments, the scFv comprises a VH domain of the sequence of SEQ ID NO: 1248, and a VL domain of the sequence of SEQ ID NO: 1249.

In some embodiments, the VH domain of the sequence of SEQ ID NO: 1248 is operably linked via its C-terminus to the N-terminus of the VL domain of the sequence of SEQ ID NO: 1249.

In some embodiments, the VL domain of the sequence of SEQ ID NO: 1249 is operably linked via its C-terminus to the N-terminus of the VH domain of the sequence of SEQ ID NO: 1248.

In some embodiments, the scFv comprises a linker sequence of SEQ ID NO: 1237.

In some embodiments, the VH of the sequence of SEQ ID NO: 1248 and the VL domain of the sequence of SEQ ID NO: 1249 are operably linked via a linker sequence of SEQ ID NO: 1237.

In some embodiments, the scFv comprises a sequence having at least 90% sequence identity to SEQ ID NO: 1207 or SEQ ID NO: 1208.

In some embodiments, the scFv comprises the sequence of SEQ ID NO: 1207 or SEQ ID NO: 1208.

In some embodiments, the scFv comprises a VH domain having at least 90% sequence identity to SEQ ID NO: 1250.

In some embodiments, the scFv comprises a VH domain of the sequence of SEQ ID NO: 1250.

In some embodiments, the scFv comprises a VL domain having at least 90% sequence identity to SEQ ID NO: 1251.

In some embodiments, the scFv comprises a VL domain of the sequence of SEQ ID NO: 1251.

In some embodiments, the scFv comprises a VH domain having at least 90% sequence identity to SEQ ID NO: 1250, and a VL domain having at least 90% sequence identity to SEQ ID NO: 1251.

In some embodiments, the scFv comprises a VH domain of the sequence of SEQ ID NO: 1250, and a VL domain of the sequence of SEQ ID NO: 1251.

In some embodiments, the VH domain of the sequence of SEQ ID NO: 1250 is operably linked via its C-terminus to the N-terminus of the VL domain of the sequence of SEQ ID NO: 1251.

In some embodiments, the VL domain of the sequence of SEQ ID NO: 1251 is operably linked via its C-terminus to the N-terminus of the VH domain of the sequence of SEQ ID NO: 1250.

The recombinant nucleic acid molecule as described herein, wherein the scFv comprises a linker sequence of SEQ ID NO: 1237.

In some embodiments, the VH of the sequence of SEQ ID NO: 1250 and the VL domain of the sequence of SEQ ID NO: 1251 are operably linked via a linker sequence of SEQ ID NO: 1237.

In some embodiments, the scFv comprises a sequence having at least 90% sequence identity to SEQ ID NO: 1209 or SEQ ID NO: 1210.

In some embodiments, the scFv comprises the sequence of SEQ ID NO: 1209 or SEQ ID NO: 1210.

In some embodiments, the scFv comprises a VH domain having at least 90% sequence identity to SEQ ID NO: 1252.

In some embodiments, the scFv comprises a VH domain of the sequence of SEQ ID NO: 1252.

In some embodiments, the scFv comprises a VL domain having at least 90% sequence identity to SEQ ID NO: 1253.

In some embodiments, the scFv comprises a VL domain of the sequence of SEQ ID NO: 1253.

In some embodiments, the scFv comprises a VH domain having at least 90% sequence identity to SEQ ID NO: 1252, and a VL domain having at least 90% sequence identity to SEQ ID NO: 1253.

In some embodiments, the scFv comprises a VH domain of the sequence of SEQ ID NO: 1252, and a VL domain of the sequence of SEQ ID NO: 1253.

In some embodiments, the VH domain of the sequence of SEQ ID NO: 1252 is operably linked via its C-terminus to the N-terminus of the VL domain of the sequence of SEQ ID NO: 1253.

In some embodiments, the VL domain of the sequence of SEQ ID NO: 1253 is operably linked via its C-terminus to the N-terminus of the VH domain of the sequence of SEQ ID NO: 1252.

In some embodiments, the scFv comprises a linker sequence of SEQ ID NO: 1237.

In some embodiments, the VH of the sequence of SEQ ID NO: 1252 and the VL domain of the sequence of SEQ ID NO: 1253 are operably linked via a linker sequence of SEQ ID NO: 1237.

In some embodiments, the scFv comprises a sequence having at least 90% sequence identity to SEQ ID NO: 1246 or SEQ ID NO: 1247.

In some embodiments, the scFv comprises the sequence of SEQ ID NO: 1246 or SEQ ID NO: 1247.

In some embodiments, the antibody or antibody fragment specifically binds to a second epitope is within the amino acid sequence ASRHHPTTLAVGICSPASRSISL (SEQ ID NO:1231).

In some embodiments, the scFv comprises a VH domain that comprises a CDRH1 of SEQ ID NO: 853, a CDRH2 of SEQ ID NO: 906, and a CDRH3 of SEQ ID NO: 959, and a VL domain that comprises a CDRL1 of SEQ ID NO: 1065, a CDRL2 of SEQ ID NO: 1118, and a CDRL3 of SEQ ID NO: 1171.

In some embodiments, the scFv comprises a VH domain having at least 90% sequence identity to SEQ ID NO: 800.

In some embodiments, the scFv comprises a VL domain having at least 90% sequence identity to SEQ ID NO: 1012.

In some embodiments, the scFv comprises a VH domain having at least 90% sequence identity to SEQ ID NO: 800, and a VL domain having at least 90% sequence identity to SEQ ID NO: 1012.

In some embodiments, the scFv comprises a linker sequence of SEQ ID NO: 782.

In some embodiments, the recombinant nucleic acid molecule as described herein further comprises a sequence encoding a TCR constant domain.

In some embodiments, the antibody or antibody fragment is operatively linked to the sequence encoding a TCR constant domain, thereby forming a TFP.

In some embodiments, the TCR constant domain is a TCR alpha constant domain or portion thereof, a TCR beta constant domain or portion thereof, a TCR alpha constant domain or portion thereof and a TCR beta constant domain or portion thereof, a TCR gamma constant domain or portion thereof, a TCR delta constant domain or portion thereof, or a TCR gamma constant domain or portion thereof and a TCR delta constant domain or portion thereof.

In some embodiments, the recombinant nucleic acid molecule as described herein further comprises a leader sequence.

In some embodiments, the nucleic acid is selected from the group consisting of a DNA and an RNA.

In some embodiments, the nucleic acid is a mRNA.

In some embodiments, the nucleic acid is a circRNA.

In some embodiments, the nucleic acid comprises a nucleotide analog.

In some embodiments, the nucleotide analog is selected from the group consisting of 2'-O-methyl, 2'-O-methoxy-ethyl (2'-O-MOE), 2'-O-aminopropyl, 2'-deoxy, T-deoxy-2'-fluoro, 2'-O-aminopropyl (2'-O-AP), 2'-O-dimethylamino-ethyl (2'-O-DMAOE), 2'-O-dimethylaminopropyl (2'-O-DMAP), T-O-dimethylaminoethyloxyethyl (2'-O-DMAEOE), 2'-O—N-methylacetamido (2'-O-NMA) modified, a locked nucleic acid (LNA), an ethylene nucleic acid (ENA), a peptide nucleic acid (PNA), a 1',5'-anhydro-hexitol nucleic acid (HNA), a morpholino, a methylphos-phonate nucleotide, a thiolphosphonate nucleotide, and a 2'-fluoro N3-P5'-phosphoramidite.

In some embodiments, the recombinant nucleic acid molecule as described herein further comprises a promoter.

In some embodiments, the nucleic acid is an in vitro transcribed nucleic acid.

In some embodiments, the nucleic acid further comprises a sequence encoding a poly(A) tail.

In some embodiments, the nucleic acid further comprises a 3'UTR sequence.

In an aspect, the present disclosure provide polypeptides encoded by the recombinant nucleic acid molecule as described herein.

In an aspect, the present disclosure provide vectors comprising a recombinant nucleic acid molecule encoding the TFP as described herein.

In an aspect, the present disclosure provide vectors comprising a recombinant nucleic acid molecule encoding the antibody or antigen binding fragment as described herein.

In some embodiments, the vector as described herein further comprises a sequence encoding an siRNA, an shRNA, or an miRNA for reducing endogenous levels of CD70.

In some embodiments, the vector as described herein further comprises a sequence encoding an inhibitory molecule that comprises a first polypeptide that comprises at least a portion of an inhibitory molecule, associated with a second polypeptide that comprises a positive signal from an intracellular signaling domain.

In some embodiments, the vector as described herein further comprises a sequence encoding a TCR constant domain.

In some embodiments, the TCR constant domain is a TCR alpha constant domain or portion thereof, a TCR beta constant domain or portion thereof, a TCR alpha constant domain or portion thereof and a TCR beta constant domain or portion thereof, a TCR gamma constant domain or portion thereof, a TCR delta constant domain or portion thereof, or a TCR gamma constant domain or portion thereof and a TCR delta constant domain or portion thereof.

In some embodiments, the vector is selected from the group consisting of a DNA, a RNA, a plasmid, a lentivirus vector, adenoviral vector, a Rous sarcoma viral (RSV) vector, or a retrovirus vector.

In some embodiments, the vector as described herein further comprises a promoter.

In some embodiments, the vector is an in vitro transcribed vector.

In some embodiments, a nucleic acid sequence in the vector further comprises a poly(A) tail.

In some embodiments, a nucleic acid sequence in the vector further comprises a 3'UTR.

In an aspect, the present disclosure provide cells comprising the recombinant nucleic acid molecule as described herein, the polypeptide as described herein, or the vector as described herein.

In an aspect, the present disclosure provide cells comprising a recombinant nucleic acid molecule comprising a sequence encoding a T cell receptor (TCR) fusion protein (TFP) wherein the TFP comprises: (a) a TCR subunit comprising: (i) at least a portion of a TCR extracellular domain, and (ii) a TCR transmembrane domain, (iii) a TCR intracellular domain, and (b) an antigen binding domain that specifically binds CD70; and wherein the TCR subunit and the antigen binding domain are operatively linked.

In some embodiments, the cell is a T cell.

In some embodiments, the T cell is a human T cell.

In some embodiments, the T cell is a CD8+ or CD4+ T cell.

In some embodiments, the T cell is a human αβ T cell.

In some embodiments, the T cell is a human γδ T cell.

In some embodiments, the cell is a human NKT cell.

In an aspect, the present disclosure provide T cells comprising the recombinant nucleic acid molecule as described herein, the polypeptide as described herein, or the vector as described herein.

In an aspect, the present disclosure provide T cells comprising a recombinant nucleic acid molecule comprising a sequence encoding a T cell receptor (TCR) fusion protein (TFP) wherein the TFP comprises: (a) a TCR subunit comprising: (i) at least a portion of a TCR extracellular domain, and (ii) a TCR transmembrane domain, (iii) a TCR intracellular domain, and (b) an antigen binding domain that specifically binds CD70; and wherein the TCR subunit and the antigen binding domain are operatively linked.

In some embodiments, the T cell is a human T cell.

In some embodiments, the T cell is a CD8+ or CD4+ T cell.

In some embodiments, the T cell is a human αβ T cell.

In some embodiments, the T cell is a human γδ T cell.

In some embodiments, the cell or the T cell as described herein further comprises a nucleic acid encoding an inhibitory molecule that comprises a first polypeptide comprising at least a portion of an inhibitory molecule, associated with a second polypeptide comprising a positive signal from an intracellular signaling domain.

In some embodiments, the inhibitory molecule comprises the first polypeptide comprising at least a portion of PD-1 and the second polypeptide comprising a costimulatory domain and primary signaling domain.

In some embodiments, the inhibitory molecule comprises the sequence of SEQ ID NO: 1239 or SEQ ID NO: 1244.

In some embodiments, the sequence encoding the TFP and the nucleic acid encoding an inhibitory molecule are included in a single nucleic acid molecule.

In some embodiments, the sequence encoding the TFP and the nucleic acid encoding an inhibitory molecule are included in two separate nucleic acid molecules.

In some embodiments, the cell or the T cell as described herein further comprises a second nucleic acid sequence encoding an interleukin-15 (IL-15) polypeptide or a fragment thereof.

In some embodiments, the sequence encoding the TFP and the second nucleic acid sequence are included in a single nucleic acid molecule.

In some embodiments, the sequence encoding the TFP and the second nucleic acid sequence are included in two separate nucleic acid molecules.

In some embodiments, the sequence encoding the TFP and the second nucleic acid sequence are operatively linked by a second linker.

In some embodiments, the second linker comprises a protease cleavage site.

In some embodiments, the protease cleavage site is a 2A cleavage site.

In some embodiments, the 2A cleavage site is a T2A cleavage site.

In some embodiments, expression of IL-15 increases persistence of the cells.

In some embodiments, the IL-15 polypeptide is secreted when expressed in the cell or T cell.

In some embodiments, the IL-15 polypeptide comprises a sequence of SEQ ID NO: 1242.

In some embodiments, the second nucleic acid sequence further encodes an IL-15 receptor (IL-15R) subunit or a fragment thereof.

In some embodiments, the IL-15R subunit is IL-15R alpha (IL-15Rα).

In some embodiments, IL-15 and IL-15Rα are operatively linked by a third linker.

In some embodiments, the third linker is not a cleavable linker.

In some embodiments, the third linker comprises a sequence comprising $(G_4S)_n$, wherein G is glycine, S is serine, and n is an integer from 1 to 10.

In some embodiments, n is an integer from 1 to 4.

In some embodiments, n is 3.

In some embodiments, the third linker comprises a sequence of SEQ ID NO: 1243.

In some embodiments, the second nucleic acid sequence encodes a fusion protein comprising the IL-15 polypeptide linked to the IL-15Rα subunit.

In some embodiments, the IL-15 polypeptide is linked to N-terminus of the IL-15Rα subunit.

In some embodiments, the fusion protein comprises amino acids 30-162 of IL-15.

In some embodiments, the fusion protein comprises amino acids 31-267 of IL-15Rα.

In some embodiments, the fusion protein further comprises a sushi domain.

In some embodiments, the fusion protein comprises a sequence of SEQ ID NO: 1244.

In some embodiments, the fusion protein is expressed on cell surface when expressed in the cell or T cell.

In some embodiments, the fusion protein is secreted when expressed in the cell or T cell.

In some embodiments, the cell or T cell further comprises a third nucleic acid sequence encoding a PD-1 polypeptide.

In some embodiments, the PD-1 polypeptide is operably linked via its C-terminus to the N-terminus of an intracellular domain of a costimulatory polypeptide.

In some embodiments, the third nucleic acid sequence is included in the same nucleic acid molecule as the first and second nucleic acid sequences.

In some embodiments, the PD-1 polypeptide is linked to the intracellular domain of the costimulatory polypeptide via a transmembrane domain of PD-1.

In some embodiments, the costimulatory polypeptide is chosen from a group comprising OX40, CD2, CD27, CDS, ICAM-1, ICOS (CD278), 4-1BB (CD137), GITR, CD28, CD30, CD40, BAFFR, HVEM, CD7, LIGHT, NKG2C, SLAMF7, NKp80, CD160, CD226, FcγRI, FcγRII, and FcγRIII.

In some embodiments, the intracellular domain of the costimulatory polypeptide comprises at least a portion of CD28.

In some embodiments, an extracellular domain and the transmembrane domain of PD-1 are linked to an intracellular domain of CD28.

In some embodiments, the cell or T cell comprises a fusion protein comprising an extracellular domain and a transmembrane domain of PD-1 linked to an intracellular domain of CD28 linked to IL-15Rα.

In some embodiments, the fusion protein comprises a sequence of SEQ ID NO: 1254 or SEQ ID NO: 1262.

In some embodiments, the cell or T cell further comprises a second nucleic acid sequence encoding an interleukin-15 receptor alpha (IL-15Rα) polypeptide or a fragment thereof.

In some embodiments, the sequence encoding the TFP and the second nucleic acid sequence are included in a single nucleic acid molecule.

In some embodiments, the sequence encoding the TFP and the second nucleic acid sequence are included in two separate nucleic acid molecules.

In some embodiments, the sequence encoding the TFP and the second nucleic acid sequence are operatively linked by a second linker.

In some embodiments, the second linker comprises a protease cleavage site.

In some embodiments, the protease cleavage site is a 2A cleavage site.

In some embodiments, the 2A cleavage site is a T2A cleavage site.

In some embodiments, the second nucleic acid sequence further encodes PD-1 or a fragment thereof.

In some embodiments, the second nucleic acid sequence encodes the extracellular domain of PD-1.

In some embodiments, the second nucleic acid sequence encodes the extracellular and transmembrane domain of PD-1.

In some embodiments, the second nucleic acid sequence further encodes CD28 or a fragment thereof.

In some embodiments, the second nucleic acid sequence encodes the intracellular domain of CD28.

In some embodiments, the second nucleic acid sequence encodes a fusion protein comprising the PD-1 extracellular domain and transmembrane domain linked to the CD28 intracellular domain linked to IL-15Rα.

In some embodiments, the CD28 intracellular domain is linked to the intracellular domain of IL-15Rα.

In some embodiments, the second nucleic acid sequence comprises a sequence of SEQ ID NO: 1245.

In some embodiments, the recombinant nucleic acid molecule further comprises a third nucleic acid sequence encoding an interleukin-15 (IL-15) polypeptide or a fragment thereof.

In some embodiments, the IL-15 polypeptide or a fragment thereof is secreted when expressed in the cell or T cell.

In some embodiments, the cell or T cell secretes the IL-15 polypeptide in response to a T cell activation agent.

In some embodiments, IL-15 signaling is increased in response to a T cell activation agent.

In some embodiments, the T cell activation agent comprises anti-CD3 antibody or a fragment thereof, anti-CD28 antibody or a fragment thereof, a cytokine, an antigen that binds the antigen binding domain of the TFP, or any combinations thereof.

In some embodiments, the TFP functionally interacts with an endogenous TCR complex when expressed in a T cell.

In some embodiments, the cell or T cell comprises a functional disruption of an endogenous TCR.

In some embodiments, the cell or T cell is an allogeneic cell or T cell.

In some embodiments, the cell or T cell comprises a functional disruption of the endogenous CD70 gene.

In some embodiments, the cell or T cell comprises a functional disruption of the endogenous CIITA gene.

In some embodiments, the cell or T cell further comprises an antisense siRNA, an shRNA, or an miRNA for reducing endogenous levels of CD70.

In some embodiments, the cell or T cell further comprises an antisense siRNA, an shRNA, or an miRNA for reducing endogenous levels of CIITA.

In some embodiments, the cell or T cell further comprises a sequence encoding a fusion protein comprising an anti-CD70 antibody domain and an ER retention domain.

In some embodiments, the recombinant nucleic acid comprises the sequence encoding the fusion protein comprising an anti-CD70 antibody domain and an ER retention domain.

In some embodiments, the sequence encoding the TFP and the sequence encoding the fusion protein comprising an anti-CD70 antibody domain and an ER retention domain are contained in the same operon.

In some embodiments, the ER retention domain is encoded by any one of SEQ ID NOs: 756-779.

In some embodiments, the sequence encoding the fusion protein further comprises a CD8 alpha transmembrane domain between the anti-CD70 antibody domain and the ER retention domain.

In some embodiments, the sequence encoding the fusion protein further comprises a sequence encoding a CD8 alpha signal peptide 5' to the sequence encoding the anti-CD70 antibody domain.

In some embodiments, the antibody domain comprises the recombinant nucleic acid as described herein.

In some embodiments, the cell or T cell comprises a cell-surface expressed CD70 bound to an anti-CD70 antibody.

In some embodiments, the anti-CD70 antibody is the antibody or antigen binding fragment encoded by the recombinant nucleic acid as described herein.

In some embodiments, the anti-CD70 antibody has greater affinity for CD70 than the antibody or antigen binding fragment encoded by the recombinant nucleic acid as described herein.

In some embodiments, the cell or T cell further comprises a heterologous sequence encoding an inhibitory molecule that comprises a first polypeptide that comprises at least a portion of an inhibitory molecule, associated with a second polypeptide that comprises a positive signal from an intracellular signaling domain.

In some embodiments, the cell or T cell further comprises a heterologous sequence encoding a TCR constant domain.

In some embodiments, the TCR constant domain is a TCR alpha constant domain or portion thereof, a TCR beta constant domain or portion thereof, a TCR alpha constant domain or portion thereof and a TCR beta constant domain or portion thereof, a TCR gamma constant domain or portion thereof, a TCR delta constant domain or portion thereof, or a TCR gamma constant domain or portion thereof and a TCR delta constant domain or portion thereof.

In some embodiments, the TCR alpha constant domain or the TCR beta constant domain is murine.

In some embodiments, the cell or T cell comprises the recombinant nucleic acid molecule encoding any one of the amino acid sequences selected from SEQ ID NOs: 1233, 1236, 1240, and 1264.

In an aspect, the present disclosure provide pharmaceutical compositions comprising the cell or T cell as described herein and a pharmaceutically acceptable carrier.

In an aspect, the present disclosure provide methods of producing the cell or T cell as described herein, the method comprising: (i) disrupting an endogenous CD70 gene, thereby producing a cell or T cell containing a functional disruption of an endogenous CD70 gene; and (ii) transducing the cell or T cell containing the functional disruption of the endogenous CD70 gene with the recombinant nucleic acid as described herein, or the vector as described herein.

In some embodiments, the disrupting comprises transducing the cell or T cell with a nuclease protein or a nucleic acid sequence encoding a nuclease protein that targets the endogenous CD70 gene.

In some embodiments, the method further comprises disrupting an endogenous TCR.

In an aspect, the present disclosure provide methods of producing the cell or T cell as described herein, the method comprising transducing a cell or T cell comprising a disruption of an endogenous CD70 gene with the recombinant nucleic acid as described herein, or the vector as described herein.

In some embodiments, the cell or T cell further comprises a disruption of an endogenous TCR.

In an aspect, the present disclosure provide methods of producing the cell or T cell as described herein, the method comprising: (i) transducing a cell or T cell with the recombinant nucleic acid as described herein, or the vector as described herein; and (ii) contacting the cell or T cell with an anti-CD70 antibody that binds to CD70 on the cell surface.

In some embodiments, the anti-CD70 antibody is the antibody or antigen binding fragment encoded by the recombinant nucleic acid as described herein.

In some embodiments, the anti-CD70 antibody has greater affinity for CD70 than the antibody or antigen binding fragment encoded by the recombinant nucleic acid as described herein.

In some embodiments, the contacting occurs prior to the transducing.

In some embodiments, the contacting occurs up to 1 day prior to the transducing.

In some embodiments, the contacting occurs after the transducing.

In some embodiments, the contacting occurs up to 5 days after the transducing.

In some embodiments, the method as describe herein further comprises sub-culturing the cells in media that does not comprise the anti-CD70 antibody 4 or more days after the transducing.

In some embodiments, the sub-culturing comprises sub-culturing the cells in media that does not comprise the anti-CD70 antibody 7 or more days after the transducing.

In an aspect, the present disclosure provide methods of treating a cancer in a subject in need thereof, comprising administering to the subject an effective amount of the pharmaceutical composition as described herein.

In an aspect, the present disclosure provide methods of treating a cancer in a subject in need thereof, the method comprising administering to the subject a pharmaceutical composition comprising (a) the cell or T cell as described herein; and (b) a pharmaceutically acceptable carrier.

In some embodiments, the cancer is a cancer associated with elevated expression of CD70.

In some embodiments, the method as describe herein further comprises administering to the subject an agent that increases levels of CD70 in the cancer cells.

In some embodiments, the agent that increases levels of CD70 is a hypomethylating agent.

In some embodiments, the hypomethylating agent is 5-azacitidine or decitabine.

In some embodiments, the disease or the condition is selected from the group consisting of T cell lymphoma, diffuse large B-cell lymphoma (DLBCL), mantle cell lymphoma (MCL), acute myeloid leukemia (AML), myelodysplastic syndrome (MDS), an Epstein-Barr virus (EBV)+ cancer, and/or a human papilloma virus (HPV)+cancer.

In some embodiments, the disease or the condition is selected from the group consisting of kidney cancer, renal cell carcinoma, lung cancer, pancreatic cancer, ovarian cancer, esophageal cancer, nasopharyngeal carcinoma, mesothelioma, glioblastoma, thymic carcinoma, breast cancer, head and neck cancer, and gastric cancer.

In some embodiments, the subject is a human.

In an aspect, the present disclosure provide methods of producing the cell or T cell as described herein, the method comprising: (i) disrupting an endogenous CIITA gene, thereby producing a cell or T cell containing a functional disruption of an endogenous CIITA gene; and (ii) transducing the cell or T cell containing the functional disruption of the endogenous CIITA gene with the recombinant nucleic acid as described herein, or the vector as described herein.

In some embodiments, the disrupting comprises transducing the cell or T cell with a nuclease protein or a nucleic acid sequence encoding a nuclease protein that targets the endogenous CIITA gene.

In some embodiments, the method further comprises disrupting an endogenous TCR.

In an aspect, the present disclosure provide methods of producing the cell or T cell as described herein, the method comprising transducing a cell or T cell comprising a disruption of an endogenous CIITA gene with the recombinant nucleic acid as described herein, or the vector as described herein.

In some embodiments, the cell or T cell further comprises a disruption of an endogenous TCR.

In an aspect, the present disclosure provide methods of producing the cell or T cell as described herein, the method comprising transducing a cell or T cell with the recombinant nucleic acid as described herein or the vector as described herein and a sequence encoding a fusion protein comprising an anti-CD70 antibody domain and an ER retention domain.

In some embodiments, the recombinant nucleic acid or vector and the sequence encoding the fusion protein comprising an anti-CD70 antibody domain and an ER retention domain are transduced simultaneously.

In some embodiments, the recombinant nucleic acid or vector comprises the sequence encoding the fusion protein comprising an anti-CD70 antibody domain and an ER retention domain.

In some embodiments, the sequence encoding the TFP and the sequence encoding the fusion protein comprising an anti-CD70 antibody domain and an ER retention domain are contained in the same operon.

In some embodiments, the recombinant nucleic acid or vector are transduced before or after the sequence encoding the fusion protein comprising an anti-CD70 antibody domain and an ER retention domain.

In some embodiments, the ER retention domain is encoded by any one of SEQ ID NOs: 756-779.

In some embodiments, the sequence encoding the fusion protein comprising an anti-CD70 antibody domain and an ER retention domain further comprises a CD8 alpha transmembrane domain between the anti-CD70 antibody domain and the ER retention domain.

In some embodiments, the sequence encoding the fusion protein comprising an anti-CD70 antibody domain and an ER retention domain further comprises a sequence encoding a CD8 alpha signal peptide 5' to the sequence encoding the anti-CD70 antibody domain.

In some embodiments, the antibody domain comprises the anti-CD70 antibody as described herein.

INCORPORATION BY REFERENCE

All publications, patents, and patent applications mentioned in this specification are herein incorporated by reference to the same extent as if each individual publication, patent, or patent application was specifically and individually indicated to be incorporated by reference.

BRIEF DESCRIPTION OF THE DRAWINGS

The novel features of the invention are set forth with particularity in the appended claims. A better understanding of the features and advantages of the present invention will be obtained by reference to the following detailed description that sets forth illustrative embodiments, in which the principles of the invention are utilized, and the accompanying drawings of which:

FIG. 6A shows detection with the anti-VHH antibody and the CD70-Fc tag. FIG. 6B shows detection with the anti-VHH antibody.

FIG. 6C shows detection with the CD70-Fc tag.

FIG. 7A shows total T cells. FIG. 7B shows TFP+ T cells. FIG. 7C shows TFP− T cells.

FIG. 8A shows total CD4+ T cells. FIG. 8B shows TFP− CD4+ T cells. FIG. 8C shows TFP+ CD4+ T cells. FIG. 8D shows total CD8+ T cells. FIG. 8E shows TFP− CD8+ T cells. FIG. 8F shows TFP+ CD8+ T cells.

FIGS. 9A and 9B show TFP− T cells. FIGS. 9C and 9D show TFP+ T cells.

FIG. 12A shows IFN-γ, TNF-α, and IL-2. FIG. 12B shows GM-CSF.

FIG. 16A shows CD4+ T cells and FIG. 16B shows CD8+ T cells.

FIG. 19A shows CD4+ T cells and FIG. 19B shows CD8+ T cells.

FIG. 27A shows CD4+ T cells and FIG. 27B shows CD8+ T cells.

FIGS. 37A-37C shows the results of epitope mapping analysis. FIG. 37A is a graph showing the results of epitope mapping for VHH antibodies shown and FIG. 37B is a graph showing the results of epitope mapping for scFv antibodies shown. FIG. 37C is a schematic summarizing the epitope binning and epitope mapping data from FIG. 36, FIG. 37A, and FIG. 37B.

FIG. 39A shows scFv binders in a vLvH orientation and FIG. 39B shows scFv binders in a vHvL orientation.

FIG. 46 is a table summarizing the data shown in FIGS. 42-45.

FIG. 60A shows total CD3+ T cells. FIG. 60B shows CD4+ T cells. FIG. 60C shows CD8+ T cells.

FIG. 68A shows T cells from Donor R017 and FIG. 68B shows T cells from Donor R022.

FIG. 69A shows T cells from Donor R017 and FIG. 69B shows T cells from Donor R022.

FIG. 70A shows CD8+ T cells from Donor R017. FIG. 70B shows CD4+ T cells from Donor R017. FIG. 70C shows CD8+ T cells from Donor R022. FIG. 70D shows CD4+ T cells from Donor R022.

FIG. 71A shows T cells from Donor R017 and FIG. 71B shows T cells from Donor R022.

FIG. 72A shows tumor volume upon initial treatment and FIG. 72B shows tumor volume upon rechallenge.

FIG. 73A shows a graph of tumor growth in all groups in a single plot. FIG. 73B shows individual plots for each group. FIG. 73C shows images of luminescence for each subject.

FIG. 74A shows a graph of tumor growth in all groups in a single plot. FIG. 74B shows individual plots for each group at the 1e7 dose of TFP+ T cells.

DETAILED DESCRIPTION

Figure 1:
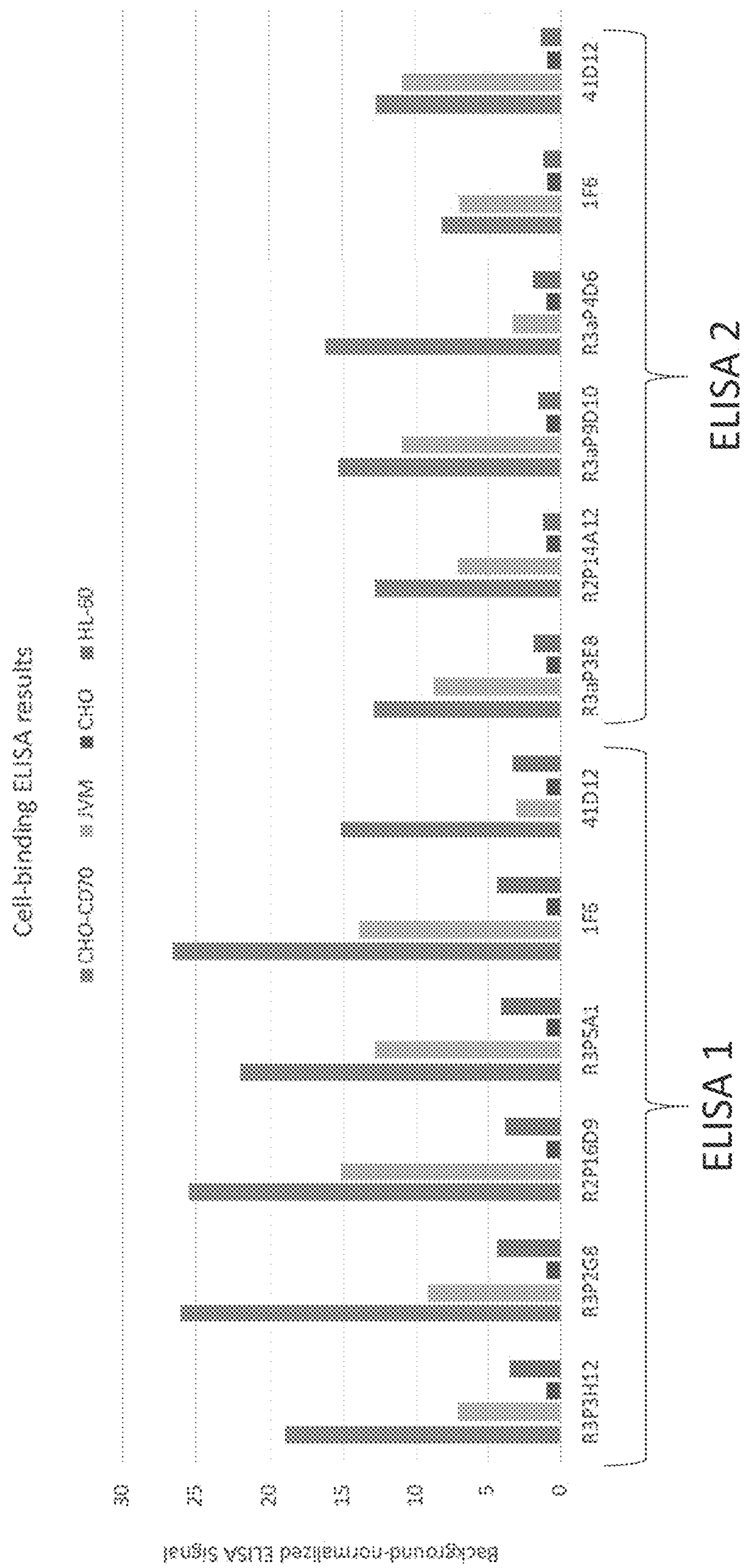
FIG. 1 is a graphical representation of an ELISA assay detecting binding of the anti-CD70 VHHs and scFvs shown to CHO-CD70 cells (high CD70 expression), JVM3 cells (medium-low CD70 expression), wild type CHO cells (negative control), HL60 cells (negative control).

The present disclosure provides a recombinant nucleic acid molecule comprising a sequence encoding a T cell receptor (TCR) fusion protein (TFP) wherein the TFP comprises: (a) a TCR subunit comprising: (i) at least a portion of a TCR extracellular domain, and (ii) a TCR transmembrane domain, (iii) a TCR intracellular domain, and (b) an antigen binding domain that specifically binds CD70; and wherein the TCR subunit and the antigen binding domain are operatively linked, or a vector comprising the recombinant nucleic acid molecule. Also disclosed herein is a recombinant nucleic acid molecule comprising a sequence encoding an antibody or a fragment thereof that specifically binds CD70. Also disclosed herein a cell, for example, a T cell, comprising the recombinant nucleic acid comprising a sequence encoding the TFP as described herein. The cell can further comprise a nucleic acid encoding an inhibitory molecule that comprises a first polypeptide comprising at least a portion of an inhibitory molecule (e.g., PD-1) associated with a second polypeptide comprising a positive signal from an intracellular signaling domain (e.g., a costimulatory domain and primary signaling domain), and/or a nucleic acid encoding an interleukin-15 (IL-15) polypeptide or a fragment thereof, an IL-15 receptor (IL-15R) subunit or a fragment thereof, or a combination thereof. Also disclosed herein is a pharmaceutical compression comprising the cell as described herein and a pharmaceutically acceptable carrier, methods of treating cancer in a subject by administering the pharmaceutical composition as described herein into the subject, and methods of producing the cell as described herein.

Definitions

Unless otherwise defined, all terms of art, notations and other scientific terminology used herein are intended to have the meanings commonly understood by those of skill in the art to which this invention pertains. In some cases, terms with commonly understood meanings are defined herein for clarity and/or for ready reference, and the inclusion of such definitions herein should not necessarily be construed to represent a difference over what is generally understood in the art. The techniques and procedures described or referenced herein are generally well understood and commonly employed using conventional methodologies by those skilled in the art, such as, for example, the widely utilized molecular cloning methodologies described in Sambrook et al., *Molecular Cloning: A Laboratory Manual* 4th ed. (2012) Cold Spring Harbor Laboratory Press, Cold Spring Harbor, NY. As appropriate, procedures involving the use of commercially available kits and reagents are generally carried out in accordance with manufacturer-defined protocols and conditions unless otherwise noted.

As used herein, the singular forms "a," "an," and "the" include the plural referents unless the context clearly indicates otherwise. The terms "include," "such as," and the like are intended to convey inclusion without limitation, unless otherwise specifically indicated.

As used herein, the term "comprise" or variations thereof such as "comprises" or "comprising" are to be read to indicate the inclusion of any recited integer (e.g. a feature, element, characteristic, property, method/process step or limitation) or group of integers (e.g. features, element, characteristics, properties, method/process steps or limitations) but not the exclusion of any other integer or group of integers. Thus, as used herein, the term "comprising," is inclusive and does not exclude additional, unrecited integers or method/process steps.

In embodiments of any of the compositions and methods provided herein, "comprising" may be replaced with "consisting essentially of" or "consisting of". The phrase "consisting essentially of" is used herein to require the specified integer(s) or steps as well as those which do not materially affect the character or function of the claimed invention. As used herein, the term "consisting" is used to indicate the presence of the recited integer (e.g. a feature, element, characteristic, property, method/process step or limitation) or group of integers (e.g. features, element, characteristics, properties, method/process steps or limitations) alone.

Unless defined otherwise, all technical and scientific terms used herein have the same meaning as commonly understood by one of ordinary skill in the art to which the invention pertains.

The term "about" indicates and encompasses an indicated value and a range above and below that value. In certain embodiments, the term "about" indicates the designated value ±10%, ±5%, or ±1%. In certain embodiments, where applicable, the term "about" indicates the designated value(s) ± one standard deviation of that value(s).

The term "antibody," as used herein, refers to a protein, or polypeptide sequences derived from an immunoglobulin molecule, which specifically binds to an antigen. Antibodies can be intact immunoglobulins of polyclonal or monoclonal origin, or fragments thereof and can be derived from natural or from recombinant sources.

The term "antigen-binding domain" means the portion of an antibody that is capable of specifically binding to an antigen or epitope. One example of an antigen-binding domain is an antigen-binding domain formed by a $V_H$-$V_L$ dimer of an antibody. Another example of an antigen-binding domain is an antigen-binding domain formed by diversification of certain loops from the tenth fibronectin type III domain of an Adnectin.

The terms "antibody fragment" or "antibody binding domain" refer to at least one portion of an antibody, or recombinant variants thereof, that contains the antigen binding domain, i.e., an antigenic determining variable region of an intact antibody, that is sufficient to confer recognition and specific binding of the antibody fragment to a target, such as an antigen and its defined epitope. Examples of antibody fragments include, but are not limited to, Fab, Fab', F(ab')2, and Fv fragments, single-chain (sc)Fv ("scFv") antibody fragments, linear antibodies, single domain antibodies (abbreviated "sdAb") (either $V_L$ or $V_H$), camelid $V_{HH}$ domains, and multi-specific antibodies formed from antibody fragments.

The term "scFv" refers to a fusion protein comprising at least one antibody fragment comprising a variable region of a light chain and at least one antibody fragment comprising a variable region of a heavy chain, wherein the light and heavy chain variable regions are contiguously linked via a short flexible polypeptide linker, and capable of being expressed as a single polypeptide chain, and wherein the scFv retains the specificity of the intact antibody from which it is derived.

"Heavy chain variable region" or "$V_H$" (or, in the case of single domain antibodies, e.g., nanobodies, "$V_{HH}$") with regard to an antibody refers to the fragment of the heavy chain that contains three CDRs interposed between flanking stretches known as framework regions, these framework regions are generally more highly conserved than the CDRs and form a scaffold to support the CDRs.

Unless specified, as used herein a scFv may have the $V_L$ and $V_H$ variable regions in either order, e.g., with respect to the N-terminal and C-terminal ends of the polypeptide, the scFv may comprise $V_L$-linker-$V_H$ or may comprise $V_H$-linker-$V_L$.

The portion of the TFP composition of the invention comprising an antibody or antibody fragment thereof may exist in a variety of forms where the antigen binding domain is expressed as part of a contiguous polypeptide chain including, for example, a single domain antibody fragment (sdAb) or heavy chain antibodies HCAb, a single chain antibody (scFv) derived from a murine, humanized or human antibody (Harlow et al., 1999, In: Using Antibodies: A Laboratory Manual, Cold Spring Harbor Laboratory Press, N.Y.; Harlow et al., 1989, In: Antibodies: A Laboratory Manual, Cold Spring Harbor, N.Y.; Houston et al., 1988, *Proc. Natl. Acad. Sci. USA* 85:5879-5883; Bird et al., 1988, *Science* 242:423-426). In one aspect, the antigen binding domain of a TFP composition of the present disclosure comprises an antibody fragment. In a further aspect, the TFP comprises an antibody fragment that comprises a scFv or a sdAb.

The term "antibody heavy chain," refers to the larger of the two types of polypeptide chains present in antibody molecules in their naturally occurring conformations, and which normally determines the class to which the antibody belongs.

The term "antibody light chain," refers to the smaller of the two types of polypeptide chains present in antibody molecules in their naturally occurring conformations. Kappa ("κ") and lambda ("λ") light chains refer to the two major antibody light chain isotypes.

The term "recombinant antibody" refers to an antibody that is generated using recombinant DNA technology, such as, for example, an antibody expressed by a bacteriophage or yeast expression system. The term should also be construed to mean an antibody which has been generated by the synthesis of a DNA molecule encoding the antibody and which DNA molecule expresses an antibody protein, or an amino acid sequence specifying the antibody, wherein the DNA or amino acid sequence has been obtained using recombinant DNA or amino acid sequence technology which is available and well known in the art.

The term "antigen" or "Ag" refers to a molecule that is capable of being bound specifically by an antibody, or otherwise provokes an immune response. This immune response may involve either antibody production, or the activation of specific immunologically-competent cells, or both.

The skilled artisan will understand that any macromolecule, including virtually all proteins or peptides, can serve as an antigen. Furthermore, antigens can be derived from recombinant or genomic DNA. A skilled artisan will understand that any DNA, which comprises a nucleotide sequences or a partial nucleotide sequence encoding a protein that elicits an immune response therefore encodes an "antigen" as that term is used herein. Furthermore, one skilled in the art will understand that an antigen need not be encoded solely by a full-length nucleotide sequence of a gene. It is readily apparent that the present disclosure includes, but is not limited to, the use of partial nucleotide sequences of more than one gene and that these nucleotide sequences are arranged in various combinations to encode polypeptides that elicit the desired immune response. Moreover, a skilled artisan will understand that an antigen need not be encoded by a "gene" at all. It is readily apparent that an antigen can be generated synthesized or can be derived from a biological sample or might be macromolecule besides a polypeptide. Such a biological sample can include, but is not limited to a tissue sample, a tumor sample, a cell or a fluid with other biological components.

"CD70" is a cytokine that belongs to the tumor necrosis factor (TNF) ligand family. This cytokine is a ligand for TNFRSF27/CD27. It is a surface antigen on activated, but not on resting, T and B lymphocytes. CD70 induces proliferation of costimulated T cells, enhances the generation of cytolytic T cells, and contributes to T cell activation. CD70 is also reported to play a role in regulating B-cell activation, cytotoxic function of natural killer cells, and immunoglobulin synthesis.

"Class II Major Histocompatibility Complex Transactivator" or "CIITA" encodes a protein with an acidic transcriptional activation domain, 4 LRRs (leucine-rich repeats) and a GTP binding domain. The protein is located in the nucleus and acts as a positive regulator of class II major histocompatibility complex gene transcription, and is referred to as the "master control factor" for the expression of these genes. The protein also binds GTP and uses GTP binding to facilitate its own transport into the nucleus. Once in the nucleus it does not bind DNA but rather uses an intrinsic acetyltransferase (AT) activity to act in a coactivator-like fashion.

The term "anti-tumor effect" refers to a biological effect which can be manifested by various means, including but not limited to, e.g., a decrease in tumor volume, a decrease in the number of tumor cells, a decrease in the number of metastases, an increase in life expectancy, decrease in tumor cell proliferation, decrease in tumor cell survival, or amelioration of various physiological symptoms associated with the cancerous condition. An "anti-tumor effect" can also be manifested by the ability of the peptides, polynucleotides, cells and antibodies of the invention in prevention of the occurrence of tumor in the first place.

"Humanized" forms of non-human antibodies are chimeric antibodies that contain minimal sequence derived from the non-human antibody. A humanized antibody is generally a human antibody (recipient antibody) in which residues from one or more CDRs are replaced by residues from one or more CDRs of a non-human antibody (donor antibody). The donor antibody can be any suitable non-human antibody, such as a mouse, rat, rabbit, chicken, or non-human primate antibody having a desired specificity, affinity, or biological effect. In some instances, selected framework region residues of the recipient antibody are replaced by the corresponding framework region residues from the donor antibody. Humanized antibodies may also comprise residues that are not found in either the recipient antibody or the donor antibody. Such modifications may be made to further refine antibody function. For further details, see Jones et al., *Nature,* 1986, 321:522-525; Riechmann et al., *Nature,* 1988, 332:323-329; and Presta, *Curr. Op. Struct. Biol.,* 1992, 2:593-596, each of which is incorporated by reference in its entirety.

A "human antibody" is one which possesses an amino acid sequence corresponding to that of an antibody produced by a human or a human cell, or derived from a non-human source that utilizes a human antibody repertoire or human antibody-encoding sequences (e.g., obtained from human sources or designed de novo). Human antibodies specifically exclude humanized antibodies.

"Affinity" refers to the strength of the sum total of non-covalent interactions between a single binding site of a molecule (e.g., an antibody) and its binding partner (e.g., an antigen or epitope). Unless indicated otherwise, as used herein, "affinity" refers to intrinsic binding affinity, which reflects a 1:1 interaction between members of a binding pair (e.g., antibody and antigen or epitope). The affinity of a molecule X for its partner Y can be represented by the dissociation equilibrium constant ($K_D$). The kinetic components that contribute to the dissociation equilibrium constant are described in more detail below. Affinity can be measured by common methods known in the art, including those described herein, such as surface plasmon resonance (SPR) technology (e.g., BIACORE®) or biolayer interferometry (e.g., FORTEBIO®).

With regard to the binding of an antibody or fragment thereof to a target molecule, the terms "bind," "specific binding," "specifically binds to," "specific for," "selectively binds," and "selective for" a particular antigen (e.g., a polypeptide target) or an epitope on a particular antigen mean binding that is measurably different from a non-specific or non-selective interaction (e.g., with a non-target molecule). Specific binding can be measured, for example, by measuring binding to a target molecule and comparing it to binding to a non-target molecule. Specific binding can also be determined by competition with a control molecule that mimics the epitope recognized on the target molecule. In that case, specific binding is indicated if the binding of the antibody to the target molecule is competitively inhibited by the control molecule.

The term "autologous" refers to any material derived from the same individual to whom it is later to be re-introduced into the individual.

The term "allogeneic" refers to any material derived from a different animal of the same species or different patient as the individual to whom the material is introduced. Two or more individuals are said to be allogeneic to one another when the genes at one or more loci are not identical. In some aspects, allogeneic material from individuals of the same species may be sufficiently unlike genetically to interact antigenically.

The term "xenogeneic" refers to a graft derived from an animal of a different species.

The term "treating" (and variations thereof such as "treat" or "treatment") refers to clinical intervention in an attempt to alter the natural course of a disease or condition in a subject in need thereof. Treatment can be performed both for prophylaxis and during the course of clinical pathology. Desirable effects of treatment include preventing occurrence or recurrence of disease, alleviation of symptoms, diminishment of any direct or indirect pathological consequences of the disease, preventing metastasis, decreasing the rate of disease progression, amelioration or palliation of the disease state, and remission or improved prognosis.

As used herein, a "therapeutically effective amount" is the amount of a composition or an active component thereof sufficient to provide a beneficial effect or to otherwise reduce a detrimental non-beneficial event to the individual to whom the composition is administered. By "therapeutically effective dose" herein is meant a dose that produces one or more desired or desirable (e.g., beneficial) effects for which it is administered, such administration occurring one or more times over a given period of time. The exact dose will depend on the purpose of the treatment, and will be ascertainable by one skilled in the art using known techniques (see, e.g. Lieberman, Pharmaceutical Dosage Forms (vols. 1-3, 1992); Lloyd, The Art, Science and Technology of Pharmaceutical Compounding (1999); and Pickar, Dosage Calculations (1999)).

As used herein, a "T cell receptor (TCR) fusion protein" or "TFP" includes a recombinant polypeptide derived from the various polypeptides comprising the TCR that is generally capable of i) binding to a surface antigen on target cells and ii) interacting with other polypeptide components of the intact TCR complex, typically when co-located in or on the surface of a T cell. A "TFP T cell" is a T cell that has been transduced according to the methods disclosed herein and that expresses a TFP, e.g., incorporated into the natural TCR. In some embodiments, the T cell is a CD4+ T cell, a CD8+ T cell, or a CD4+/CD8+ T cell. In some embodiments, the TFP T cell is an NK cell or a regulatory T cell.

As is used herein, the terms "T cell receptor" and "T cell receptor complex" are used interchangeably to refer to a molecule found on the surface of T cells that is, in general, responsible for recognizing antigens. The TCR comprises a heterodimer consisting of a TCR alpha and TCR beta chain in 95% of T cells, whereas 5% of T cells have TCRs consisting of TCR gamma and TCR delta chains. The TCR further comprises one or more of CD3ε, CD3γ, and CD3δ. In some embodiments, the TCR comprises CD3ε. In some embodiments, the TCR comprises CD3γ. In some embodiments, the TCR comprises CD3δ. In some embodiments, the TCR comprises CD3ζ. Engagement of the TCR with antigen, e.g., with antigen and MHC, results in activation of its T cells through a series of biochemical events mediated by associated enzymes, co-receptors, and specialized accessory molecules. In some embodiments, the constant domain of human TCR alpha has a sequence of SEQ ID NO: 711. In some embodiments, the constant domain of human TCR alpha has an IgC domain having a sequence of SEQ ID NO: 712, a transmembrane domain having a sequence of SEQ ID NO: 713, and an intracellular domain having a sequence of SS. In some embodiments, the constant domain of murine TCR alpha has a sequence of SEQ ID NO:1267. In some embodiments, the constant domain of human TCR beta has a sequence of SEQ ID NO: 715. In some embodiments, the constant domain of human TCR beta has an IgC domain having a sequence of SEQ ID NO: 716, a transmembrane domain having a sequence of SEQ ID NO: 717, and an intracellular domain having a sequence of SEQ ID NO: 719. In some embodiments, the constant domain of murine TCR beta has a sequence of SEQ ID NO:1268. In some embodiments, the constant domain of TCR delta has a sequence of SEQ ID NO: 725. In some embodiments, the constant domain of TCR delta has an IgC domain having a sequence of SEQ ID NO: 726, a transmembrane domain having a sequence of SEQ ID NO: 727, and an intracellular domain having a sequence of L. In some embodiments, the constant domain of TCR gamma has a sequence of SEQ ID NO: 721. In some embodiments, the constant domain of TCR gamma has an IgC domain having a sequence of SEQ ID NO: 722, a transmembrane domain having a sequence of SEQ ID NO: 723, and an intracellular domain having a sequence of SEQ ID NO: 724. In some embodiments, CD3 epsilon has a sequence of SEQ ID NO: 694. In some embodiments, CD3 epsilon has an extracellular domain having a sequence of SEQ ID NO: 696, a transmembrane domain having a sequence of SEQ ID NO: 697, and an intracellular domain, e.g., an intracellular signaling domain, having a sequence of SEQ ID NO: 698. In some embodiments, CD3 delta has a sequence of SEQ ID NO: 704. In some embodiments, CD3 delta has an extracellular domain having a sequence of SEQ ID NO: 706, a transmembrane domain having a sequence of SEQ ID NO: 707, and an intracellular domain, e.g., an intracellular signaling domain, having a sequence of SEQ ID NO: 708. In some embodiments, CD3 gamma has a sequence of SEQ ID NO: 699. In some embodiments, CD3 gamma has an extracellular domain having a sequence of SEQ ID NO: 701, a transmembrane domain having a sequence of SEQ ID NO: 702, and an intracellular domain, e.g., an intracellular signaling domain, having a sequence of SEQ ID NO: 703.

As used herein, the term "subject" means a mammalian subject. Exemplary subjects include humans, monkeys, dogs, cats, mice, rats, cows, horses, camels, goats, rabbits, and sheep. In certain embodiments, the subject is a human. A "patient" is a subject suffering from or at risk of developing a disease, disorder or condition or otherwise in need of the compositions and methods provided herein. In some embodiments, the subject has cancer, e.g., a cancer described herein.

As used herein, "preventing" refers to the prevention of the disease or condition, e.g., tumor formation, in the patient. For example, if an individual at risk of developing a tumor or other form of cancer is treated with the methods of the present invention and does not later develop the tumor or other form of cancer, then the disease has been prevented, at least over a period of time, in that individual.

The term "package insert" is used to refer to instructions customarily included in commercial packages of therapeutic or diagnostic products (e.g., kits) that contain information about the indications, usage, dosage, administration, combination therapy, contraindications and/or warnings concerning the use of such therapeutic or diagnostic products.

The term "cytotoxic agent," as used herein, refers to a substance that inhibits or prevents a cellular function and/or causes cell death or destruction.

A "chemotherapeutic agent" refers to a chemical compound useful in the treatment of cancer. Chemotherapeutic agents include "anti-hormonal agents" or "endocrine therapeutics" which act to regulate, reduce, block, or inhibit the effects of hormones that can promote the growth of cancer.

The term "tumor" refers to all neoplastic cell growth and proliferation, whether malignant or benign, and all pre-cancerous and cancerous cells and tissues. The terms "cancer," "cancerous," "cell proliferative disorder," "proliferative disorder" and "tumor" are not mutually exclusive as referred to herein. The terms "cell proliferative disorder" and "proliferative disorder" refer to disorders that are associated with some degree of abnormal cell proliferation. In some embodiments, the cell proliferative disorder is a cancer. In some aspects, the tumor is a solid tumor. In some aspects, the tumor is a hematologic malignancy.

The term "cancer" refers to a disease characterized by the rapid and uncontrolled growth of aberrant cells. Cancer cells can spread locally or through the bloodstream and lymphatic system to other parts of the body. Examples of various cancers are described herein and include but are not limited to, breast cancer, prostate cancer, ovarian cancer, cervical cancer, skin cancer, pancreatic cancer, colorectal cancer, renal cancer, liver cancer, brain cancer, lymphoma, leukemia, lung cancer and the like.

The term "pharmaceutical composition" refers to a preparation which is in such form as to permit the biological activity of an active ingredient contained therein to be effective in treating a subject, and which contains no additional components which are unacceptably toxic to the subject in the amounts provided in the pharmaceutical composition.

The terms "modulate" and "modulation" refer to reducing or inhibiting or, alternatively, activating or increasing, a recited variable.

The terms "increase" and "activate" refer to an increase of 10%, 20%, 30%, 40%, 50%, 60%, 70%, 75%, 80%, 85%, 90%, 95%, 100%, 2-fold, 3-fold, 4-fold, 5-fold, 10-fold, 20-fold, 50-fold, 100-fold, or greater in a recited variable.

The terms "reduce" and "inhibit" refer to a decrease of 10%, 20%, 30%, 40%, 50%, 60%, 70%, 75%, 80%, 85%, 90%, 95%, 2-fold, 3-fold, 4-fold, 5-fold, 10-fold, 20-fold, 50-fold, 100-fold, or greater in a recited variable.

The term "agonize" refers to the activation of receptor signaling to induce a biological response associated with activation of the receptor. An "agonist" is an entity that binds to and agonizes a receptor.

The term "antagonize" refers to the inhibition of receptor signaling to inhibit a biological response associated with activation of the receptor. An "antagonist" is an entity that binds to and antagonizes a receptor.

The term "effector T cell" includes T helper (i.e., CD4+) cells and cytotoxic (i.e., CD8+) T cells. CD4+ effector T cells contribute to the development of several immunologic processes, including maturation of B cells into plasma cells and memory B cells, and activation of cytotoxic T cells and macrophages. CD8+ effector T cells destroy virus-infected cells and tumor cells. See Seder and Ahmed, *Nature Immunol.,* 2003, 4:835-842, incorporated by reference in its entirety, for additional information on effector T cells.

The term "regulatory T cell" includes cells that regulate immunological tolerance, for example, by suppressing effector T cells. In some aspects, the regulatory T cell has a CD4+CD25+Foxp3+ phenotype. In some aspects, the regulatory T cell has a CD8+CD25+ phenotype. See Nocentini et al., *Br. J. Pharmacol.,* 2012, 165:2089-2099, incorporated by reference in its entirety, for additional information on regulatory T cells expressing CD70.

The term "dendritic cell" refers to a professional antigen-presenting cell capable of activating a naïve T cell and stimulating growth and differentiation of a B cell.

The phrase "disease associated with expression of CD70" includes, but is not limited to, a disease associated with expression of CD70 or condition associated with cells which express CD70 including, e.g., proliferative diseases such as a cancer or malignancy or a precancerous condition. In one aspect, the disease is a cancer.

In some cases, the cancer is T cell lymphoma, diffuse large B-cell lymphoma (DLBCL), mantle cell lymphoma (MCL), acute myeloid leukemia (AML), myelodysplastic syndrome (MDS), an Epstein-Barr virus (EBV)+cancer, or a human papilloma virus (HPV)+cancer. In some cases, the cancer is kidney cancer, renal cell carcinoma, lung cancer, pancreatic cancer, ovarian cancer, esophageal cancer, nasopharyngeal carcinoma, mesothelioma, glioblastoma, thymic carcinoma, breast cancer, head and neck cancer, or gastric cancer.

In some cases, the cancer can be acute lymphocytic cancer, acute myeloid leukemia, alveolar rhabdomyosarcoma, bladder cancer (e.g., bladder carcinoma), bone cancer, brain cancer (e.g., medulloblastoma), breast cancer, cancer of the anus, anal canal, or anorectum, cancer of the eye, cancer of the intrahepatic bile duct, cancer of the joints, cancer of the neck, gallbladder, or pleura, cancer of the nose, nasal cavity, or middle ear, cancer of the oral cavity, cancer of the vulva, chronic lymphocytic leukemia (CLL), chronic myeloid cancer, colon cancer, esophageal cancer, cervical cancer, fibrosarcoma, gastrointestinal carcinoid tumor, head and neck cancer (e.g., head and neck squamous cell carcinoma), glioblastoma, Hodgkin's lymphoma, hypopharynx cancer, kidney cancer, larynx cancer, leukemia, liquid tumors, liver cancer, lung cancer (e.g., non-small cell lung carcinoma), lymphoma, diffuse large-B-cell lymphoma, follicular lymphoma, malignant mesothelioma, mastocytoma, melanoma, multiple myeloma, nasopharynx cancer, non-Hodgkin's lymphoma (NHL), B-chronic lymphocytic leukemia, hairy cell leukemia, acute lymphocytic leukemia (ALL), Burkitt's lymphoma, ovarian cancer, pancreatic cancer, peritoneum, omentum, mesentery cancer, pharynx cancer, prostate cancer, RCC, ccRCC, rectal cancer, renal cancer, skin cancer, small intestine cancer, soft tissue cancer, solid tumors, stomach cancer, testicular cancer, thyroid cancer, or ureter cancer.

The term "conservative sequence modifications" refers to amino acid modifications that do not significantly affect or alter the binding characteristics of the antibody or antibody fragment containing the amino acid sequence. Such conservative modifications include amino acid substitutions, additions and deletions. Modifications can be introduced into an antibody or antibody fragment of the invention by standard techniques known in the art, such as site-directed mutagenesis and PCR-mediated mutagenesis. Conservative amino acid substitutions are ones in which the amino acid residue is replaced with an amino acid residue having a similar side chain. Families of amino acid residues having similar side chains have been defined in the art. These families include amino acids with basic side chains (e.g., lysine, arginine, histidine), acidic side chains (e.g., aspartic acid, glutamic acid), uncharged polar side chains (e.g., glycine, asparagine, glutamine, serine, threonine, tyrosine, cysteine, tryptophan), nonpolar side chains (e.g., alanine, valine, leucine, isoleucine, proline, phenylalanine, methionine), beta-branched side chains (e.g., threonine, valine, isoleucine) and aromatic side chains (e.g., tyrosine, phenylalanine, tryptophan, histidine). Thus, one or more amino acid residues within a TFP of the invention can be replaced with other amino acid residues from the same side chain family and the altered TFP can be tested using the functional assays described herein.

The term "stimulation" refers to a primary response induced by binding of a stimulatory domain or stimulatory molecule (e.g., a TCR/CD3 complex) with its cognate ligand thereby mediating a signal transduction event, such as, but not limited to, signal transduction via the TCR/CD3 complex. Stimulation can mediate altered expression of certain molecules, and/or reorganization of cytoskeletal structures, and the like.

The term "stimulatory molecule" or "stimulatory domain" refers to a molecule or portion thereof expressed by a T cell that provides the primary cytoplasmic signaling sequence(s) that regulate primary activation of the TCR complex in a stimulatory way for at least some aspect of the T cell signaling pathway. In one aspect, the primary signal is initiated by, for instance, binding of a TCR/CD3 complex with an MHC molecule loaded with peptide, and which leads to mediation of a T cell response, including, but not limited to, proliferation, activation, differentiation, and the like. A primary cytoplasmic signaling sequence (also referred to as a "primary signaling domain") that acts in a stimulatory manner may contain a signaling motif which is known as immunoreceptor tyrosine-based activation motif or "ITAM". Examples of an ITAM containing primary cytoplasmic signaling sequence that is of particular use in the invention includes, but is not limited to, those derived from TCR zeta, FcR gamma, FcR beta, CD3 gamma, CD3 delta, CD3 epsilon, CD5, CD22, CD79a, CD79b, CD278 (also known as "ICOS") and CD66d.

The term "antigen presenting cell" or "APC" refers to an immune system cell such as an accessory cell (e.g., a B-cell, a dendritic cell, and the like) that displays a foreign antigen complexed with major histocompatibility complexes (MHC's) on its surface. T cells may recognize these complexes using their T cell receptors (TCRs). APCs process antigens and present them to T cells.

An "intracellular signaling domain," as the term is used herein, refers to an intracellular portion of a molecule. The intracellular signaling domain generates a signal that promotes an immune effector function of the TFP containing cell, e.g., a TFP-expressing T cell. Examples of immune effector function, e.g., in a TFP-expressing T cell, include cytolytic activity and T helper cell activity, including the secretion of cytokines. In an embodiment, the intracellular signaling domain can comprise a primary intracellular signaling domain. Exemplary primary intracellular signaling domains include those derived from the molecules responsible for primary stimulation, or antigen dependent simulation. In an embodiment, the intracellular signaling domain can comprise a costimulatory intracellular domain. Exemplary costimulatory intracellular signaling domains include those derived from molecules responsible for costimulatory signals, or antigen independent stimulation.

A primary intracellular signaling domain can comprise an ITAM ("immunoreceptor tyrosine-based activation motif"). Examples of ITAM containing primary cytoplasmic signaling sequences include, but are not limited to, those derived from CD3 zeta, FcR gamma, FcR beta, CD3 gamma, CD3 delta, CD3 epsilon, CD5, CD22, CD79a, CD79b, CD66d, DAP10 and DAP12.

The term "costimulatory molecule" refers to the cognate binding partner on a T cell that specifically binds with a costimulatory ligand, thereby mediating a costimulatory response by the T cell, such as, but not limited to, proliferation. Costimulatory molecules are cell surface molecules other than antigen receptors or their ligands that are required for an efficient immune response. Costimulatory molecules include, but are not limited to, an MHC class 1 molecule, BTLA and a Toll ligand receptor, as well as DAP10, DAP12, CD30, LIGHT, OX40, CD2, CD27, CD28, CDS, ICAM-1, LFA-1 (CD11a/CD18) and 4-1BB (CD137). A costimulatory intracellular signaling domain can be the intracellular portion of a costimulatory molecule. A costimulatory molecule can be represented in the following protein families: TNF receptor proteins, Immunoglobulin-like proteins, cytokine receptors, integrins, signaling lymphocytic activation molecules (SLAM proteins), and activating NK cell receptors. Examples of such molecules include CD27, CD28, 4-1BB (CD137), OX40, GITR, CD30, CD40, ICOS, BAFFR, HVEM, lymphocyte function-associated antigen-1 (LFA-1), CD2, CD7, LIGHT, NKG2C, SLAMF7, NKp80, CD160, B7-H3, and a ligand that specifically binds with CD83, and the like. The intracellular signaling domain can comprise the entire intracellular portion, or the entire native intracellular signaling domain, of the molecule from which it is derived, or a functional fragment thereof. The term "4-1BB" refers to a member of the TNFR superfamily with an amino acid sequence provided as GenBank Acc. No. AAA62478.2, or the equivalent residues from a non-human species, e.g., mouse, rodent, monkey, ape and the like; and a "4-1BB costimulatory domain" is defined as amino acid residues 214-255 of GenBank Acc. No. AAA62478.2, or equivalent residues from non-human species, e.g., mouse, rodent, monkey, ape and the like.

The term "encoding" refers to the inherent property of specific sequences of nucleotides in a polynucleotide, such as a gene, a cDNA, or an mRNA, to serve as templates for synthesis of other polymers and macromolecules in biological processes having either a defined sequence of nucleotides (e.g., rRNA, tRNA and mRNA) or a defined sequence of amino acids and the biological properties resulting therefrom. Thus, a gene, cDNA, or RNA, encodes a protein if transcription and translation of mRNA corresponding to that gene produces the protein in a cell or other biological system. Both the coding strand, the nucleotide sequence of which is identical to the mRNA sequence and is usually provided in sequence listings, and the non-coding strand, used as the template for transcription of a gene or cDNA, can be referred to as encoding the protein or other product of that gene or cDNA.

Unless otherwise specified, a "nucleotide sequence encoding an amino acid sequence" includes all nucleotide sequences that are degenerate versions of each other and that encode the same amino acid sequence. The phrase nucleotide sequence that encodes a protein or an RNA may also include introns to the extent that the nucleotide sequence encoding the protein may in some version contain one or more introns.

The term "endogenous" refers to any material from or produced inside an organism, cell, tissue or system.

The term "exogenous" refers to any material introduced from or produced outside an organism, cell, tissue or system.

The term "expression" refers to the transcription and/or translation of a particular nucleotide sequence driven by a promoter.

The term "functional disruption" refers to a physical or biochemical change to a specific (e.g., target) nucleic acid (e.g., gene, RNA transcript, of protein encoded thereby) that prevents its normal expression and/or behavior in the cell. In one embodiment, a functional disruption refers to a modification of the gene via a gene editing method. In one embodiment, a functional disruption prevents expression of a target gene (e.g., an endogenous gene).

The term "transfer vector" refers to a composition of matter which comprises an isolated nucleic acid and which can be used to deliver the isolated nucleic acid to the interior of a cell. Numerous vectors are known in the art including, but not limited to, linear polynucleotides, polynucleotides associated with ionic or amphiphilic compounds, plasmids, and viruses. Thus, the term "transfer vector" includes an autonomously replicating plasmid or a virus. The term should also be construed to further include non-plasmid and non-viral compounds which facilitate transfer of nucleic acid into cells, such as, for example, a polylysine compound, liposome, and the like. Examples of viral transfer vectors include, but are not limited to, adenoviral vectors, adeno-associated virus vectors, retroviral vectors, lentiviral vectors, and the like.

The term "expression vector" refers to a vector comprising a recombinant polynucleotide comprising expression control sequences operatively linked to a nucleotide sequence to be expressed. An expression vector comprises sufficient cis-acting elements for expression; other elements for expression can be supplied by the host cell or in an in vitro expression system. Expression vectors include all those known in the art, including cosmids, plasmids (e.g., naked or contained in liposomes) and viruses (e.g., lentiviruses, retroviruses, adenoviruses, and adeno-associated viruses) that incorporate the recombinant polynucleotide.

The term "lentivirus" refers to a genus of the Retroviridae family. Lentiviruses are unique among the retroviruses in being able to infect non-dividing cells; they can deliver a significant amount of genetic information into the DNA of the host cell, so they are one of the most efficient methods of a gene delivery vector. HIV, SIV, and FIV are all examples of lentiviruses.

The term "lentiviral vector" refers to a vector derived from at least a portion of a lentivirus genome, including especially a self-inactivating lentiviral vector as provided, e.g., in Milone et al., *Mol. Ther.* 17(8): 1453-1464 (2009). Other examples of lentivirus vectors that may be used in the clinic, include but are not limited to, e.g., the LENTIVECTOR™ gene delivery technology from Oxford BioMedica, the LENTIMAX™ vector system from Lentigen Technology, and the like. Nonclinical types of lentiviral vectors are also available and would be known to one skilled in the art.

The term "circularized RNA" or "circRNA" refers to a class of single-stranded RNAs with a contiguous structure that have enhanced stability and a lack of end motifs necessary for interaction with various cellular proteins. CircRNAs are 3-5' covalently closed RNA rings, and circRNAs do not display Cap or poly(A) tails. CircRNAs lack the free ends necessary for exonuclease-mediated degradation, rendering them resistant to several mechanisms of RNA turnover and granting them extended lifespans as compared to their linear mRNA counterparts. For this reason, circularization may allow for the stabilization of mRNAs that generally suffer from short half-lives and may therefore improve the overall efficacy of mRNA in a variety of applications. CircRNAs are produced by the process of splicing, and circularization occurs using conventional splice sites mostly at annotated exon boundaries (Starke et al., 2015; Szabo et al., 2015). For circularization, splice sites are used in reverse: downstream splice donors are "back-spliced" to upstream splice acceptors (see Jeck and Sharpless, 2014; Barrett and Salzman, 2016; Szabo and Salzman, 2016; Holdt et al., 2018 for review).

Three general strategies have been reported so far for RNA circularization: chemical methods using cyanogen bromide or a similar condensing agent, enzymatic methods using RNA or DNA ligases, and ribozymatic methods using self-splicing introns. In preferred embodiments, precursor RNA is synthesized by run-off transcription and then heated in the presence of magnesium ions and GTP to promote circularization. RNA so produced can efficiently transfect different kinds of cells. In one aspect, the template includes sequences for the TFP, CAR, and TCR, or combination thereof.

In some exemplary embodiments, a ribozymatic method utilizing a permuted group I catalytic intron is used. This method is more applicable to long RNA circularization and requires only the addition of GTP and Mg2+ as cofactors. This permuted intron-exon (PIE) splicing strategy consists of fused partial exons flanked by half-intron sequences. In vitro, these constructs undergo the double transesterification reactions characteristic of group I catalytic introns, but because the exons are fused, they are excised as covalently 5' and 3' linked circles.

The term "homologous" or "identity" refers to the subunit sequence identity between two polymeric molecules, e.g., between two nucleic acid molecules, such as, two DNA molecules or two RNA molecules, or between two polypeptide molecules. When a subunit position in both of the two molecules is occupied by the same monomeric subunit; e.g., if a position in each of two DNA molecules is occupied by adenine, then they are homologous or identical at that position. The homology between two sequences is a direct function of the number of matching or homologous positions; e.g., if half (e.g., five positions in a polymer ten subunits in length) of the positions in two sequences are homologous, the two sequences are 50% homologous; if 90% of the positions (e.g., 9 of 10), are matched or homologous, the two sequences are 90% homologous.

The term "isolated" means altered or removed from the natural state. For example, a nucleic acid or a peptide naturally present in a living animal is not "isolated," but the same nucleic acid or peptide partially or completely separated from the coexisting materials of its natural state is "isolated." An isolated nucleic acid or protein can exist in substantially purified form, or can exist in a non-native environment such as, for example, a host cell.

In the context of the present invention, the following abbreviations for the commonly occurring nucleic acid bases are used. "A" refers to adenosine, "C" refers to cytosine, "G" refers to guanosine, "T" refers to thymidine, and "U" refers to uridine.

The term "operably linked" or "transcriptional control" refers to functional linkage between a regulatory sequence and a heterologous nucleic acid sequence resulting in expression of the latter. For example, a first nucleic acid sequence is operably linked with a second nucleic acid sequence when the first nucleic acid sequence is placed in a functional relationship with the second nucleic acid sequence. For instance, a promoter is operably linked to a coding sequence if the promoter affects the transcription or expression of the coding sequence. Operably linked DNA sequences can be contiguous with each other and, e.g., where necessary to join two protein coding regions, are in the same reading frame.

The term "parenteral" administration of an immunogenic composition includes, e.g., subcutaneous (s.c.), intravenous (i.v.), intramuscular (i.m.), or intrasternal injection, intratumoral, or infusion techniques.

The term "nucleic acid" or "polynucleotide" refers to deoxyribonucleic acids (DNA) or ribonucleic acids (RNA) and polymers thereof in either single- or double-stranded form. Unless specifically limited, the term encompasses nucleic acids containing known analogues of natural nucleotides that have similar binding properties as the reference nucleic acid and are metabolized in a manner similar to naturally occurring nucleotides. Unless otherwise indicated, a particular nucleic acid sequence also implicitly encompasses conservatively modified variants thereof (e.g., degenerate codon substitutions), alleles, orthologs, SNPs, and complementary sequences as well as the sequence explicitly indicated. Specifically, degenerate codon substitutions may be achieved by generating sequences in which the third position of one or more selected (or all) codons is substituted with mixed-base and/or deoxyinosine residues (Batzer et al., *Nucleic Acid Res.* 19:5081 (1991); Ohtsuka et al., *J. Biol. Chem.* 260:2605-2608 (1985); and Rossolini et al., *Mol. Cell. Probes* 8:91-98 (1994)).

The terms "peptide," "polypeptide," and "protein" are used interchangeably, and refer to a compound comprised of amino acid residues covalently linked by peptide bonds. A protein or peptide must contain at least two amino acids, and no limitation is placed on the maximum number of amino acids that can comprise a protein's or peptide's sequence. Polypeptides include any peptide or protein comprising two or more amino acids joined to each other by peptide bonds. As used herein, the term refers to both short chains, which also commonly are referred to in the art as peptides, oligopeptides and oligomers, for example, and to longer chains, which generally are referred to in the art as proteins, of which there are many types. "Polypeptides" include, for example, biologically active fragments, substantially homologous polypeptides, oligopeptides, homodimers, heterodimers, variants of polypeptides, modified polypeptides, derivatives, analogs, fusion proteins, among others. A polypeptide includes a natural peptide, a recombinant peptide, or a combination thereof.

The term "promoter" refers to a DNA sequence recognized by the transcription machinery of the cell, or introduced synthetic machinery, that can initiate the specific transcription of a polynucleotide sequence.

The term "promoter/regulatory sequence" refers to a nucleic acid sequence which can be used for expression of a gene product operably linked to the promoter/regulatory sequence. In some instances, this sequence may be the core promoter sequence and in other instances, this sequence may also include an enhancer sequence and other regulatory elements which are required for expression of the gene product. The promoter/regulatory sequence may, for example, be one which expresses the gene product in a tissue specific manner.

The term "constitutive" promoter refers to a nucleotide sequence which, when operably linked with a polynucleotide which encodes or specifies a gene product, causes the gene product to be produced in a cell under most or all physiological conditions of the cell.

The term "inducible" promoter refers to a nucleotide sequence which, when operably linked with a polynucleotide which encodes or specifies a gene product, causes the gene product to be produced in a cell substantially only when an inducer which corresponds to the promoter is present in the cell.

The term "tissue-specific" promoter refers to a nucleotide sequence which, when operably linked with a polynucleotide encodes or specified by a gene, causes the gene product to be produced in a cell substantially only if the cell is a cell of the tissue type corresponding to the promoter.

The terms "linker" and "flexible polypeptide linker" as used in the context of a scFv refers to a peptide linker that consists of amino acids such as glycine and/or serine residues used alone or in combination, to link variable heavy and variable light chain regions together. In one embodiment, the flexible polypeptide linker is a Gly/Ser linker and comprises the amino acid sequence (Gly-Gly-Gly-Ser)n, where n is a positive integer equal to or greater than 1. For example, n=1, n=2, n=3, n=4, n=5, n=6, n=7, n=8, n=9 and n=10. In one embodiment, the flexible polypeptide linkers include, but are not limited to, $(Gly_4Ser)_4$ or $(Gly_4Ser)_3$. In another embodiment, the linkers include multiple repeats of $(Gly_2Ser)$, (GlySer) or $(Gly_3Ser)$. Also included within the scope of the invention are linkers described in WO2012/138475 (incorporated herein by reference). In some instances, the linker sequence comprises $(G_4S)_n$, wherein n=2 to 4. In some instances, the linker sequence comprises $(G_4S)_n$, wherein n=1 to 3.

As used herein, a 5' cap (also termed an RNA cap, an RNA 7-methylguanosine cap or an RNA m7G cap) is a modified guanine nucleotide that has been added to the "front" or 5' end of a eukaryotic messenger RNA shortly after the start of transcription. The 5' cap consists of a terminal group which is linked to the first transcribed nucleotide. Its presence is critical for recognition by the ribosome and protection from RNases. Cap addition is coupled to transcription, and occurs co-transcriptionally, such that each influences the other. Shortly after the start of transcription, the 5' end of the mRNA being synthesized is bound by a cap-synthesizing complex associated with RNA polymerase. This enzymatic complex catalyzes the chemical reactions that are required for mRNA capping. Synthesis proceeds as a multi-step biochemical reaction. The capping moiety can be modified to modulate functionality of mRNA such as its stability or efficiency of translation.

As used herein, "in vitro transcribed RNA" refers to RNA, preferably mRNA, which has been synthesized in vitro. Generally, the in vitro transcribed RNA is generated from an in vitro transcription vector. The in vitro transcription vector comprises a template that is used to generate the in vitro transcribed RNA.

As used herein, a "poly(A)" is a series of adenosines attached by polyadenylation to the mRNA. In the preferred embodiment of a construct for transient expression, the polyA is between 50 and 5000, preferably greater than 64, more preferably greater than 100, most preferably greater than 300 or 400. Poly(A) sequences can be modified chemically or enzymatically to modulate mRNA functionality such as localization, stability or efficiency of translation.

As used herein, "polyadenylation" refers to the covalent linkage of a polyadenylyl moiety, or its modified variant, to a messenger RNA molecule. In eukaryotic organisms, most messenger RNA (mRNA) molecules are polyadenylated at the 3' end. The 3' poly(A) tail is a long sequence of adenine nucleotides (often several hundred) added to the pre-mRNA through the action of an enzyme, polyadenylate polymerase. In higher eukaryotes, the poly(A) tail is added onto transcripts that contain a specific sequence, the polyadenylation signal. The poly(A) tail and the protein bound to it aid in protecting mRNA from degradation by exonucleases. Polyadenylation is also important for transcription termination, export of the mRNA from the nucleus, and translation. Polyadenylation occurs in the nucleus immediately after transcription of DNA into RNA, but additionally can also occur later in the cytoplasm. After transcription has been terminated, the mRNA chain is cleaved through the action of an endonuclease complex associated with RNA polymerase. The cleavage site is usually characterized by the presence of the base sequence AAUAAA (SEQ ID NO: 689) near the cleavage site. After the mRNA has been cleaved, adenosine residues are added to the free 3' end at the cleavage site.

As used herein, "transient" refers to expression of a non-integrated transgene for a period of hours, days or weeks, wherein the period of time of expression is less than the period of time for expression of the gene if integrated into the genome or contained within a stable plasmid replicon in the host cell.

The term "signal transduction pathway" refers to the biochemical relationship between a variety of signal transduction molecules that play a role in the transmission of a signal from one portion of a cell to another portion of a cell. The phrase "cell surface receptor" includes molecules and complexes of molecules capable of receiving a signal and transmitting signal across the membrane of a cell.

The term, a "substantially purified" cell refers to a cell that is essentially free of other cell types. A substantially purified cell also refers to a cell which has been separated from other cell types with which it is normally associated in its naturally occurring state. In some instances, a population of substantially purified cells refers to a homogenous population of cells. In other instances, this term refers simply to cell that have been separated from the cells with which they are naturally associated in their natural state. In some aspects, the cells are cultured in vitro. In other aspects, the cells are not cultured in vitro.

The term "therapeutic" as used herein means a treatment. A therapeutic effect is obtained by reduction, suppression, remission, or eradication of a disease state.

The term "prophylaxis" as used herein means the prevention of or protective treatment for a disease or disease state.

In the context of the present invention, "tumor antigen" or "hyperproliferative disorder antigen" or "antigen associated with a hyperproliferative disorder" refers to antigens that are common to specific hyperproliferative disorders. In certain aspects, the hyperproliferative disorder antigens of the present invention are derived from, cancers including but not limited to primary or metastatic melanoma, thymoma, lymphoma, sarcoma, mesothelioma, renal cell carcinoma, stomach cancer, breast cancer, lung cancer, gastric cancer, ovarian cancer, NHL, leukemias, uterine cancer, prostate cancer, colon cancer, cervical cancer, bladder cancer, kidney cancer, prostate cancer, ovarian cancer, cervical cancer, skin cancer, brain cancer, pancreatic cancer, colorectal cancer, renal cancer, liver cancer, brain cancer, lymphoma, leukemia, endometrial cancer, and stomach cancer.

In some instances, the disease is a cancer selected from the group consisting of acute lymphocytic cancer, acute myeloid leukemia, alveolar rhabdomyosarcoma, bladder cancer (e.g., bladder carcinoma), bone cancer, brain cancer (e.g., medulloblastoma), breast cancer, cancer of the anus, anal canal, or anorectum, cancer of the eye, cancer of the intrahepatic bile duct, cancer of the joints, cancer of the neck, gallbladder, or pleura, cancer of the nose, nasal cavity, or middle ear, cancer of the oral cavity, cancer of the vulva, chronic lymphocytic leukemia (CLL), chronic myeloid cancer, colon cancer, esophageal cancer, cervical cancer, fibrosarcoma, gastrointestinal carcinoid tumor, head and neck cancer (e.g., head and neck squamous cell carcinoma), glioblastoma, Hodgkin's lymphoma, hypopharynx cancer, kidney cancer, larynx cancer, leukemia, liquid tumors, liver cancer, lung cancer (e.g., non-small cell lung carcinoma), lymphoma, diffuse large-B-cell lymphoma, follicular lymphoma, malignant mesothelioma, mastocytoma, melanoma, multiple myeloma, nasopharynx cancer, non-Hodgkin's lymphoma (NHL), B-chronic lymphocytic leukemia, hairy cell leukemia, acute lymphocytic leukemia (ALL), Burkitt's lymphoma, ovarian cancer, pancreatic cancer, peritoneum, omentum, mesentery cancer, pharynx cancer, prostate cancer, RCC, ccRCC, rectal cancer, renal cancer, skin cancer, small intestine cancer, soft tissue cancer, solid tumors, stomach cancer, testicular cancer, thyroid cancer, or ureter cancer.

In some cases, the disease is a cancer selected from the group consisting of T cell lymphoma, diffuse large B-cell lymphoma (DLBCL), mantle cell lymphoma (MCL), acute myeloid leukemia (AML), myelodysplastic syndrome (MDS), an Epstein-Barr virus (EBV)+cancer, or a human papilloma virus (HPV)+cancer. In some cases, the cancer is kidney cancer, renal cell carcinoma, lung cancer, pancreatic cancer, ovarian cancer, esophageal cancer, nasopharyngeal carcinoma, mesothelioma, glioblastoma, thymic carcinoma, breast cancer, head and neck cancer, or gastric cancer The term "transfected" or "transformed" or "transduced" refers to a process by which exogenous nucleic acid is transferred or introduced into the host cell. A "transfected" or "transformed" or "transduced" cell is one which has been transfected, transformed or transduced with exogenous nucleic acid. The cell includes the primary subject cell and its progeny.

The term "specifically binds," refers to an antibody, an antibody fragment or a specific ligand, which recognizes and binds a cognate binding partner (e.g., CD70) present in a sample, but which does not necessarily and substantially recognize or bind other molecules in the sample.

Ranges: throughout this disclosure, various aspects of the present disclosure can be presented in a range format. It should be understood that the description in range format is merely for convenience and brevity and should not be construed as an inflexible limitation on the scope of the present disclosure. Accordingly, the description of a range should be considered to have specifically disclosed all the possible subranges as well as individual numerical values within that range. For example, description of a range such as from 1 to 6 should be considered to have specifically disclosed subranges such as from 1 to 3, from 1 to 4, from 1 to 5, from 2 to 4, from 2 to 6, from 3 to 6 etc., as well as individual numbers within that range, for example, 1, 2, 2.7, 3, 4, 5, 5.3, and 6. As another example, a range such as 95-99% identity, includes something with 95%, 96%, 97%, 98% or 99% identity, and includes subranges such as 96-99%, 96-98%, 96-97%, 97-99%, 97-98% and 98-99% identity. This applies regardless of the breadth of the range.

"Programmed cell death protein 1," also known as PD-1, CD279 (cluster of differentiation 279), PDCD1, PD1, SLEB2, hPD-1, hSLE1, and Programmed cell death 1, refers to a protein on the surface of cells that has a role in regulating the immune system's response to the cells of the human body by down-regulating the immune system and promoting self-tolerance by suppressing T cell inflammatory activity. This prevents autoimmune diseases, but it can also prevent the immune system from killing cancer cells. PD-1 is an immune checkpoint and guards against autoimmunity, e.g., through two mechanisms. First, it promotes apoptosis (programmed cell death) of antigen-specific T-cells in lymph nodes. Second, it reduces apoptosis in regulatory T cells (anti-inflammatory, suppressive T cells). PD-1 is a cell surface receptor that belongs to the immunoglobulin superfamily and is expressed on T cells and pro-B cells. PD-1 binds two ligands, PD-L1 and PD-L2. PD-1, as used herein, includes any of the recombinant or naturally-occurring forms of PD-1 or variants or homologs thereof that have or maintain PD-1 activity (e.g., at least 40% 50%, 60%, 70%, 80%, 90%, 95%, 96%, 97%, 98%, 99% or 100% activity). In some aspects, the variants or homologs have at least 40%, 45%, 50%, 55%, 60%, 65%, 70%, 75%, 80%, 85%, 90%, 95%, 96%, 97%, 98%, 99% or 100% amino acid sequence identity across the whole sequence or a portion of the sequence (e.g., a 50, 100, 150 or 200 continuous amino acid portion) compared to a naturally occurring PD-1. In some embodiments, PD-1 is substantially identical to the protein identified by the UniProt reference number Q15116 or a variant or homolog having substantial identity thereto. The human and murine amino acid and nucleic acid sequences of PD-1 can be found in a public database, such as GenBank, UniProt and Swiss-Prot. For example, the murine and human PD-1 sequences corresponds to UniProt Accession No. Q02242 and Q15116, respectively, and have the sequences:

```
human PD-1
(UniProt Accession No. Q15116)
                                   (SEQ ID NO: 1228)
MQIPQAPWPVVWAVLQLGWRPGWFLDSPDRPWNPPTFSPALLVVT

EGDNATFTCSFSNTSESFVLNWYRMSPSNQTDKLAAFPEDRSQPG

QDCRFRVTQLPNGRDFHMSVVRARRNDSGTYLCGAISLAPKAQIK

ESLRAELRVTERRAEVPTAHPSPSPRPAGQFQTLVVGVVGGLLGS

LVLLVWVLAVICSRAARGTIGARRTGQPLKEDPSAVPVFSVDYGE

LDFQWREKTPEPPVPCVPEQTEYATIVFPSGMGTSSPARRGSADG

PRSAQPLRPEDGHCSWPL.

murine PD-1
(UniProt Accession No. Q02242)
                                   (SEQ ID NO: 1229)
MWVRQVPWSFTWAVLQLSWQSGWLLEVPNGPWRSLTFYPAWLTVS

EGANATFTCSLSNWSEDLMLNWNRLSPSNQTEKQAAFCNGLSQPV

QDARFQIIQLPNRHDFHMNILDTRRNDSGIYLCGAISLHPKAKIE

ESPGAELVVTERILETSTRYPSPSPKPEGRFQGMVIGIMSALVGI

PVLLLLAWALAVFCSTSMSEARGAGSKDDTLKEEPSAAPVPSVAY

EELDFQGREKTPELPTACVHTEYATIVFTEGLGASAMGRRGSADG

LQGPRPPRHEDGHCSWPL
```

"Programmed death-ligand 1 (PD-L1)," also known as cluster of differentiation 274, CD274, B7 homolog 1, B7-H, B7-H1, B7H1, PDCD1L1, PDCD1LG1, PDL1, hPD-L1, and CD274 molecule, refers to a 40 kDa type 1 transmembrane protein. In some embodiments, PD-L1 may play a major role in suppressing the adaptive arm of immune system during particular events such as, e.g., pregnancy, tissue allografts, autoimmune disease and other disease states such as, e.g., hepatitis. Normally the adaptive immune system reacts to antigens that are associated with immune system activation by exogenous or endogenous danger signals. In turn, clonal expansion of antigen-specific CD8+ T cells and/or CD4+ helper cells is propagated. The binding of PD-L1 to the inhibitory checkpoint molecule PD-1 transmits an inhibitory signal based on interaction with phosphatases (SHP-1 or SHP-2) via Immunoreceptor Tyrosine-Based Switch Motif (ITSM) motif. This reduces the proliferation of antigen-specific T-cells in lymph nodes, while simultaneously reducing apoptosis in regulatory T cells (anti-inflammatory, suppressive T cells)—further mediated by a lower regulation of the gene Bcl-2. PD-L1, as used herein, includes any of the recombinant or naturally-occurring forms of PD-L1 or variants or homologs thereof that have or maintain PD-L1 activity (e.g., at least 40% 50%, 60%, 70%, 80%, 90%, 95%, 96%, 97%, 98%, 99% or 100% activity). In some aspects, the variants or homologs have at least 40%, 45%, 50%, 55%, 60%, 65%, 70%, 75%, 80%, 85%, 90%, 95%, 96%, 97%, 98%, 99% or 100% amino acid sequence identity across the whole sequence or a portion of the sequence (e.g., a 50, 100, 150 or 200 continuous amino acid portion) compared to a naturally occurring PD-L1. In some embodiments, PD-L1 is substantially identical to the protein identified by the UniProt reference number Q9NZQ7 or a variant or homolog having substantial identity thereto.

In the context of the present invention, "PD-1 ligand", "PD-L1," and "PD-L2" refer to proteins for which PD-1 has binding affinity. In some embodiments, the PD-1 protein, or binding fragment thereof (such as the extracellular domain of the PD-1 protein), is characterized by the ability to bind the natural ligands of human PD-1, i.e., human PD-L1 (also known as CD274, UniProt Accession No. Q9NZQ7) and/or human PD-L2 (also known as CD273, UniProt Accession No. Q9BQ51) with the same (i.e. equal), enhanced or reduced (i.e. diminished) affinity as compared to the natural PD-1 protein.

As used herein, the term "fusion protein" relates to a protein which is made of polypeptide parts from different sources. Accordingly, it may be also understood as a chimeric protein. In the context of the PD-1 fusion proteins described herein, the term "fusion protein" is used interchangeably with the term "switch-receptor." Usually, fusion proteins are proteins created through the joining of two or more genes (or preferably cDNAs) that originally coded for separate proteins. Translation of this fusion gene (or fusion cDNA) results in a single polypeptide, preferably with functional properties derived from each of the original proteins. Recombinant fusion proteins are created artificially by recombinant DNA technology for use in biological research or therapeutics. Further details to the production of the fusion protein of the present invention are described herein.

The term "PD-1 fusion protein," "PD-1 switch receptor,' or "PD-1 switch molecule," as used herein, refers to the described PD-1 fusion proteins that receive an inhibitory signal by binding to PD-L1 or PD-L2, and transform (i.e., "switch") the signal via the co-stimulatory domain of the fusion protein into an activating signal.

The term "IL-15," also known as interleukin 15 and IL15, as used herein, refers to a pleiotropic cytokine that play important roles in maintenance and homeostatic expansion of various immune cells. In some embodiments, IL-15 plays a critical role in the development of the NK lineage, and in survival, expansion, and function of NK cells. In some embodiments, IL-15 contributes to enhanced anti-tumor immunity. In some embodiments, IL-15 is involved in lymphocyte homeostasis. In some embodiments, IL-15 plays multiple roles in peripheral innate and adaptive immune cell functions. In some embodiments, IL-15 has a crucial role in the induction of central memory T cell subset and enhanced cytolytic effectors upon trans-presentation by antigen presenting cells. In some embodiments, IL-15 aids in T cell survival by reducing activation induced cell death (AICD). In some embodiments, human IL-15 precursor protein has two known isoforms based on the length of signal peptide: for example, IL-15 (also referred to as IL-15-S48AA or IL-15LSP for "long signal peptide") has a 48 amino acid signal peptide and propeptide, while IL-15-S21AA or IL-15SSP (for "short signal peptide"), which is expressed from an alternatively spliced mRNA has a 21 amino acid signal peptide and propeptide. In some embodiments, IL-15SSP is not secreted, but rather stored intracellularly in the cytoplasm. IL-15, as used herein, includes any of the recombinant or naturally-occurring forms of IL-15 or variants or homologs thereof that have or maintain IL-15 activity (e.g., at least 40% 50%, 60%, 70%, 80%, 90%, 95%, 96%, 97%, 98%, 99% or 100% activity). In some aspects, the variants or homologs have at least 40%, 45%, 50%, 55%, 60%, 65%, 70%, 75%, 80%, 85%, 90%, 95%, 96%, 97%, 98%, 99% or 100% amino acid sequence identity across the whole sequence or a portion of the sequence (e.g., a 50, 100, 150 or 200 continuous amino acid portion) compared to a naturally occurring IL-15. In some embodiments, IL-15 is substantially identical to the protein identified by the UniProt reference number P40933 or a variant or homolog having substantial identity thereto.

In some embodiments, IL-15 signal peptide comprises amino acids 1-29 of IL-15 protein sequence. In some embodiments, IL-15 signal peptide comprises a sequence of SEQ ID NO: 1246. In some embodiments, IL-15 comprises amino acids 30-162 of IL-15 protein sequence. In some embodiments, IL-15 comprises any one of the sequence listed in Table 11 or a fragment thereof. In some embodiments, IL-15 comprises a sequence of SEQ ID NO: 1242.

The term "interleukin 15 receptor" or "IL-15R" refers to a type I cytokine receptor that IL-15 binds to and signals through. In some embodiments, IL-15R is composed of three subunits: IL-15 receptor alpha chain ("IL-15Rα" or CD215), IL-2 receptor beta chain ("IL-2Rβ" or CD122) and IL-2 receptor gamma/the common gamma chain ("IL-2Rγ/γc" or CD132). For example, in some embodiments, human IL-15Rα precursor protein has a 30 amino acid signal peptide, a 175 amino acid extracellular domain, a 23 amino acid single membrane-spanning transmembrane stretch, and a 39 amino acid cytoplasmic (or intracellular) domain and contains N- and O-linked glycosylation sites. In some embodiments, IL-15Rα contains a Sushi domain (amino acid 31-95), which is essential for IL-15 binding. In some embodiments, IL-15Rα exists as a soluble form (sIL-15Rα). In some embodiments, sIL-15Rα is constitutively generated from the transmembrane receptor through a defined proteolytic cleavage, and this process can be enhanced by certain chemical agents, such as PMA. In some embodiments, the human sIL-15Rα, about 42 kDa in size, may prolong the half-life of IL-15 or potentiate IL-15 signaling through IL-15 binding and IL-2Rβ/γc heterodimer. Although IL-15R shares subunits with IL-2R that contain the cytoplasmic motifs required for signal transduction, in some embodiments, IL-15 signaling has separate biological effects in vivo apart from many biological activities overlapping with IL-2 signaling due to IL-15Rα subunit that is unique to IL-15R, availability and concentration of IL-15, the kinetics and affinity of IL-15-IL-15Rα binding. In some embodiments, IL-15 binds to IL-15Rα specifically with high affinity, which then associates with a complex composed of IL-2Rβ and IL-2Rγ/γc subunits, expressed on the same cell ("cis-presentation") or on a different cell ("trans-presentation"). In some embodiments, the interaction between IL-15 and IL-15Rα is independent of the complex composed of IL-2Rβ and IL-2Rγ/γc subunits. In some embodiments, IL-15 binding to the IL-2Rβ/γc heterodimeric receptor induces JAK1 activation that phosphorylates STAT3 via the beta chain, and JAK3 activation that phosphorylates STAT5 via the gamma chain. In some embodiments, the IL-15/IL-15R interaction modulates T-cell development and homeostasis in memory CD8+ T-cell. In some embodiments, the IL-15/IL-15R interaction also modulates NK cell development, maintenance, expansion and activities.

"IL-15Rα," also known as CD215, IL-15 receptor subunit alpha, IL-15R-alpha, IL-15RA, and Interleukin-15 receptor subunit alpha, as used herein, includes any of the recombinant or naturally-occurring forms of IL-15Rα or variants or homologs thereof that have or maintain IL-15Rα activity (e.g., at least 40% 50%, 60%, 70%, 80%, 90%, 95%, 96%, 97%, 98%, 99% or 100% activity). In some aspects, the variants or homologs have at least 40%, 45%, 50%, 55%, 60%, 65%, 70%, 75%, 80%, 85%, 90%, 95%, 96%, 97%, 98%, 99% or 100% amino acid sequence identity across the whole sequence or a portion of the sequence (e.g., a 50, 100, 150 or 200 continuous amino acid portion) compared to a naturally occurring IL-15Rα. In some embodiments, IL-15Rα is substantially identical to the protein identified by the UniProt reference number Q13261 or a variant or homolog having substantial identity thereto.

"IL-2Rβ," also known as CD122, IL-2 receptor subunit beta, IL-2R subunit beta, IL-2RB, P70-75, IMD63, and Interleukin-2 receptor subunit beta, as used herein, includes any of the recombinant or naturally-occurring forms of IL-2Rβ or variants or homologs thereof that have or maintain IL-2Rβ activity (e.g., at least 40% 50%, 60%, 70%, 80%, 90%, 95%, 96%, 97%, 98%, 99% or 100% activity). In some aspects, the variants or homologs have at least 40%, 45%, 50%, 55%, 60%, 65%, 70%, 75%, 80%, 85%, 90%, 95%, 96%, 97%, 98%, 99% or 100% amino acid sequence identity across the whole sequence or a portion of the sequence (e.g., a 50, 100, 150 or 200 continuous amino acid portion) compared to a naturally occurring IL-2Rβ. In some embodiments, IL-2Rβ is substantially identical to the protein identified by the UniProt reference number P14784 or a variant or homolog having substantial identity thereto.

"IL-2 receptor gamma/the common gamma chain," also known as IL-2Rγ/γc, IL2RG, CIDX, IL-2RG, IMD4, P64, SCIDX, SCIDX1, interleukin 2 receptor subunit gamma, or CD132, as used herein, includes any of the recombinant or naturally-occurring forms of IL-2Rγ/7c or variants or homologs thereof that have or maintain IL-2Rγ/γc activity (e.g., at least 40% 50%, 60%, 70%, 80%, 90%, 95%, 96%, 97%, 98%, 99% or 100% activity). In some aspects, the variants or homologs have at least 40%, 45%, 50%, 55%, 60%, 65%, 70%, 75%, 80%, 85%, 90%, 95%, 96%, 97%, 98%, 99% or 100% amino acid sequence identity across the whole sequence or a portion of the sequence (e.g., a 50, 100, 150 or 200 continuous amino acid portion) compared to a naturally occurring IL-2Rγ/γc. In some embodiments, IL-2Rγ/γc is substantially identical to the protein identified by the UniProt reference number P31785 or a variant or homolog having substantial identity thereto.

In some embodiments, IL-15Rα cytoplasmic (or intracellular) domain comprises amino acids 229-267 of IL-15Rα protein. In some embodiments, IL-15Rα cytoplasmic (or intracellular) domain comprises a sequence of SEQ ID NO: 1248. In some embodiments, IL-15Rα Sushi domain comprises amino acids 31-95 of IL-15Rα protein. In some embodiments, IL-15Rα Sushi domain comprises a sequence of SEQ ID NO: 1250. In some embodiments, IL-15Rα comprises the transmembrane domain and the cytoplasmic (intracellular) domain of IL-15Rα protein. In some embodiments, IL-15Rα comprises amino acids 96-267 of IL-15Rα protein. In some embodiments, IL-15Rα comprises a sequence of SEQ ID NO: 1251. In some embodiments, sIL-15Rα comprises amino acids 21-205 of IL-15Rα protein. In some embodiments, sIL-15Rα comprises a sequence of SEQ ID NO: 1249.

CD70 Binding Domain

CD70 is a trimeric type II transmembrane protein of the tumor necrosis factor (TNF) ligand superfamily. CD70 can regulate T cell and B cell activation, proliferation and differentiation, and can play a role in maintaining the immune response of the body. CD70 binds to its ligand, CD27, a member of the TNF receptor superfamily (TNFRSF), and subsequently induce T cell co-stimulation and B-cell activation. When binding to CD27, CD70 can trigger intracellular signaling and CD27 cleavage.

CD70 is expressed on highly activated T-cells and B-cells, thymic epithelial cells, and some dendritic cells. Immune cell co-stimulation through CD27 binding, which activates co-stimulatory CD27/CD70 pathway, can promote proliferation or apoptosis. CD70 plays a role in cancer pathogenesis. For example, the CD70 can increase the frequency and activation of regulatory T cells (e.g., Tregs) in the tumor microenvironment. In some hematologic malignancies (e.g., AML and MCL), CD70 can be co-overexpressed with CD27, leading to self-signaling, resulting in survival/proliferation signals. Soluble CD27 is elevated in many AML patients, and can be linked to worse prognosis. Cleaved CD27 remains bound to CD70. CD70 expression can correlate with cancer "stemness" in AML and may worsen patient outcomes.

Under physiological conditions, CD70 expression is limited to transient expression on highly activated T cells and B cells, thymic epithelial cells, and some dendritic cells, but is upregulated in AML, DLBCL, RCC, MPM, and many other cancer types. For example, CD70 is highly expressed in 38% to 68% of renal clear cell carcinoma cases, 30% to 60% of renal papillary cell carcinoma cases, and in primary tumors in which CD70 is expressed. High expression of C70 can also be found in metastases. The elevated level of CD70 expression on a variety of cancer cell types makes it a promising target for tumor and hematological immunotherapy. Targeting CD70 can be used to treat a patient having a CD70-expressing cancer.

T cell receptor (TCR) fusion proteins (TFPs) The present disclosure encompasses recombinant nucleic acid constructs encoding TFPs and variants thereof, wherein the TFP comprises a binding domain, e.g., an antigen binding domain, e.g., an antibody or antibody fragment, a ligand, or a ligand binding protein, that binds specifically to CD70, e.g., human CD70, wherein the sequence of the binding domain is contiguous with and in the same reading frame as a nucleic acid sequence encoding a TCR subunit or portion thereof. The TFPs provided herein can associate with one or more endogenous (or alternatively, one or more exogenous, or a combination of endogenous and exogenous) TCR subunits in order to form a functional TCR complex. The TFP that specifically binds to CD70 described herein can be referred to as anti-CD70 TFP or a CD70.TFP.

The present disclosure also encompasses a binding domain, e.g., an anti-CD70 antibody or fragment thereof described herein, that is not a component of an anti-CD70 TFP. In some embodiments, the binding domain is comprised solely of an anti-CD70 antibody described herein and is not fused to any other polypeptide. In some embodiments, the anti-CD70 antibody or fragment thereof described herein is a component of a fusion protein other than a TFP, e.g., a CAR or other fusion protein.

The binding domain provided herein can be an antigen binding domain. The antigen binding domain can be an anti-CD70 binding domain. The binding domain provided herein can be any domain that binds to CD70 including but not limited to a monoclonal antibody, a polyclonal antibody, a recombinant antibody, a human antibody, a humanized antibody, and a functional fragment thereof, including but not limited to a single-domain antibody such as a heavy chain variable domain ($V_H$), a light chain variable domain ($V_L$) and a variable domain ($V_{HH}$) of a camelid derived nanobody, and to an alternative scaffold to function as antigen binding domain, such as a recombinant fibronectin domain, anticalin, DARPIN and the like. Likewise a natural or synthetic ligand specifically recognizing and binding CD70 can be used as antigen binding domain for the TFP. In some instances, the antigen binding domain may be derived from the same species in which the TFP will be used in. For example, for use in humans, the antigen binding domain of the TFP can comprise human or humanized residues for the antigen binding domain of an antibody or antibody fragment.

In one aspect, the antigen binding domain is a fragment, e.g., a single chain variable fragment (scFv). In one aspect, the antigen binding domain is a $V_{HH}$. In one aspect, the antigen binding domain is a Fv, a Fab, a (Fab')2, or a bi-functional (e.g., bi-specific) hybrid antibody. In one aspect, the antibodies and fragments thereof disclosed herein bind a CD70 protein with wild-type or enhanced affinity.

A humanized antibody or antibody fragment may retain a similar antigenic specificity as the original antibody, e.g., in the present disclosure, the ability to bind human CD70. In some embodiments, a humanized antibody or antibody fragment may have improved affinity and/or specificity of binding to CD70.

In an aspect, the antigen binding domain comprises a humanized or human antibody or an antibody fragment, or a camelid antibody or antibody fragment, or a murine antibody or antibody fragment. The antigen binding domain of the TFP can comprise one or more (e.g., all three) light chain complementary determining region 1 (LC CDR1), light chain complementary determining region 2 (LC CDR2), and light chain complementary determining region 3 (LC CDR3) of a humanized or human anti-CD70 binding domain described herein, and/or one or more (e.g., all three) heavy chain complementary determining region 1 (HC CDR1), heavy chain complementary determining region 2 (HC CDR2), and heavy chain complementary determining region 3 (HC CDR3) of a humanized or human anti-CD70 binding domain described herein, e.g., a humanized or human anti-CD70 binding domain comprising one or more, e.g., all three, LC CDRs and one or more, e.g., all three, HC CDRs. The antigen binding domain of the TFP can comprise one or more (e.g., all three) heavy chain complementary determining region 1 (HC CDR1), heavy chain complementary determining region 2 (HC CDR2), and heavy chain complementary determining region 3 (HC CDR3) of a humanized or human anti-CD70 binding domain described herein. For example, the antigen binding domain of the TFP can comprise one HC CDR1, HC CDR2, and HC CDR3. For another example, the antigen binding domain of the TFP may have two variable heavy chain regions, each comprising a HC CDR1, a HC CDR2 and a HC CDR3 described herein. The antigen binding domain of the TFP can comprise a humanized or human light chain variable region described herein and/or a humanized or human heavy chain variable region described herein. The antigen binding domain of the TFP can comprise a humanized heavy chain variable region described herein, e.g., at least two humanized or human heavy chain variable regions described herein. The antigen binding domain of the TFP can be a scFv comprising a light chain and a heavy chain of an amino acid sequence provided herein. The antigen binding domain of the TFP can be a single domain antibody such as $V_{HH}$ comprising a heavy chain variable region. The antigen binding domain of the TFP (e.g., a scFv or VHH) can comprise: a light chain variable region comprising an amino acid sequence having at least one, two or three modifications (e.g., substitutions) but not more than 30, 20, or 10 modifications (e.g., substitutions) of an amino acid sequence of a light chain variable region provided herein, or a sequence with 95-99% identity with an amino acid sequence provided herein; and/or a heavy chain variable region comprising an amino acid sequence having at least one, two or three modifications (e.g., substitutions) but not more than 30, 20, or 10 modifications (e.g., substitutions) of an amino acid sequence of a heavy chain variable region provided herein, or a sequence with 95-99% identity to an amino acid sequence provided herein. In one embodiment, the antigen binding domain of the TFP is a scFv, and a light chain variable region comprising an amino acid sequence described herein, is attached to a heavy chain variable region comprising an amino acid sequence described herein, via a linker, e.g., a linker described herein. In one embodiment, the antigen binding domain of the TFP includes a $(Gly4-Ser)_n$ linker, wherein n is 1, 2, 3, 4, 5, or 6, preferably 3 or 4. The light chain variable region and heavy chain variable region of a scFv can be, e.g., in any of the following orientations: light chain variable region-linker-heavy chain variable region or heavy chain variable region-linker-light chain variable region. In some instances, the linker sequence comprises a long linker (LL) sequence. In some instances, the long linker sequence comprises $(G_4S)_n$, wherein n=2 to 4. In some instances, the linker sequence comprises a short linker (SL) sequence. In some instances, the short linker sequence comprises $(G_4S)_n$, wherein n=1 to 3.

In some aspects, a non-human antibody is humanized, where specific sequences or regions of the antibody are modified to increase similarity to an antibody naturally produced in a human or fragment thereof. In one aspect, the antigen binding domain is humanized.

A humanized antibody can be produced using a variety of techniques known in the art, including but not limited to, CDR-grafting (see, e.g., European Patent No. EP 239,400; International Publication No. WO 91/09967; and U.S. Pat. Nos. 5,225,539, 5,530,101, and 5,585,089, each of which is incorporated herein in its entirety by reference), veneering or resurfacing (see, e.g., European Patent Nos. EP 592,106 and EP 519,596; Padlan, 1991, Molecular Immunology, 28(4/5):489-498; Studnicka et al., 1994, Protein Engineering, 7(6):805-814; and Roguska et al., 1994, PNAS, 91:969-973, each of which is incorporated herein by its entirety by reference), chain shuffling (see, e.g., U.S. Pat. No. 5,565,332, which is incorporated herein in its entirety by reference), and techniques disclosed in, e.g., U.S. Patent Application Publication No. US2005/0042664, U.S. Patent Application Publication No. US2005/0048617, U.S. Pat. Nos. 6,407,213, 5,766,886, International Publication No. WO 9317105, Tan et al., J. Immunol., 169:1119-25 (2002), Caldas et al., Protein Eng., 13(5):353-60 (2000), Morea et al., Methods, 20(3):267-79 (2000), Baca et al., J. Biol. Chem., 272(16):10678-84 (1997), Roguska et al., Protein Eng., 9(10):895-904 (1996), Couto et al., Cancer Res., 55 (23 Supp):5973s-5977s (1995), Couto et al., Cancer Res., 55(8):1717-22 (1995), Sandhu J S, Gene, 150(2):409-10 (1994), and Pedersen et al., J. Mol. Biol., 235(3):959-73 (1994), each of which is incorporated herein in its entirety by reference. Often, framework residues in the framework regions will be substituted with the corresponding residue from the CDR donor antibody to alter, for example improve, antigen binding. These framework substitutions are identified by methods well-known in the art, e.g., by modeling of the interactions of the CDR and framework residues to identify framework residues important for antigen binding and sequence comparison to identify unusual framework residues at particular positions (see, e.g., Queen et al., U.S. Pat. No. 5,585,089; and Riechmann et al., 1988, Nature, 332:323, which are incorporated herein by reference in their entireties.)

A humanized antibody or antibody fragment has one or more amino acid residues remaining in it from a source which is nonhuman. These nonhuman amino acid residues are often referred to as "import" residues, which are typically taken from an "import" variable domain. As provided herein, humanized antibodies or antibody fragments comprise one or more CDRs from nonhuman immunoglobulin molecules and framework regions wherein the amino acid residues comprising the framework are derived completely or mostly from human germline. Multiple techniques for humanization of antibodies or antibody fragments are well-known in the art and can essentially be performed following the method of Winter and co-workers (Jones et al., Nature, 321:522-525 (1986); Riechmann et al., Nature, 332:323-327 (1988); Verhoeyen et al., Science, 239:1534-1536 (1988)), by substituting rodent CDRs or CDR sequences for the corresponding sequences of a human antibody, i.e., CDR-grafting (EP 239,400; PCT Publication No. WO 91/09967; and U.S. Pat. Nos. 4,816,567; 6,331,415; 5,225,539; 5,530,101; 5,585,089; 6,548,640, the contents of which are incorporated herein by reference in their entirety). In such humanized antibodies and antibody fragments, substantially less than an intact human variable domain has been substituted by the corresponding sequence from a nonhuman species. Humanized antibodies are often human antibodies in which some CDR residues and possibly some framework (FR) residues are substituted by residues from analogous sites in rodent antibodies. Humanization of antibodies and antibody fragments can also be achieved by veneering or resurfacing (EP 592,106; EP 519,596; Padlan, 1991, Molecular Immunology, 28(4/5):489-498; Studnicka et al., Protein Engineering, 7(6):805-814 (1994); and Roguska et al., PNAS, 91:969-973 (1994)) or chain shuffling (U.S. Pat. No. 5,565,332), the contents of which are incorporated herein by reference in their entirety.

The choice of human variable domains, both light and heavy, to be used in making the humanized antibodies is to reduce antigenicity. According to the so-called "best-fit" method, the sequence of the variable domain of a rodent antibody is screened against the entire library of known human variable-domain sequences. The human sequence which is closest to that of the rodent is then accepted as the human framework (FR) for the humanized antibody (Sims et al., J. Immunol., 151:2296 (1993); Chothia et al., J. Mol. Biol., 196:901 (1987), the contents of which are incorporated herein by reference herein in their entirety). Another method uses a particular framework derived from the consensus sequence of all human antibodies of a particular subgroup of light or heavy chains. The same framework may be used for several different humanized antibodies (see, e.g., Nicholson et al. Mol. Immun. 34 (16-17): 1157-1165 (1997); Carter et al., Proc. Natl. Acad. Sci. USA, 89:4285 (1992); Presta et al., J. Immunol., 151:2623 (1993), the contents of which are incorporated herein by reference herein in their entirety). In some embodiments, the framework region, e.g., all four framework regions, of the heavy chain variable region are derived from a $V_H$4-4-59 germline sequence. In one embodiment, the framework region can comprise, one, two, three, four or five modifications, e.g., substitutions, e.g., from the amino acid at the corresponding murine sequence. In one embodiment, the framework region, e.g., all four framework regions of the light chain variable region are derived from a VK3-1.25 germline sequence. In one embodiment, the framework region can comprise, one, two, three, four or five modifications, e.g., substitutions, e.g., from the amino acid at the corresponding murine sequence.

In some aspects, the portion of a TFP composition of the present disclosure that comprises an antibody fragment is humanized with retention of high affinity for the target antigen and other favorable biological properties. According to one aspect of the present disclosure, humanized antibodies and antibody fragments are prepared by a process of analysis of the parental sequences and various conceptual humanized products using three-dimensional models of the parental and humanized sequences. Three-dimensional immunoglobulin models are commonly available and are familiar to those skilled in the art. Computer programs are available which illustrate and display probable three-dimensional conformational structures of selected candidate immunoglobulin sequences. Inspection of these displays permits analysis of the likely role of the residues in the functioning of the candidate immunoglobulin sequence, e.g., the analysis of residues that influence the ability of the candidate immunoglobulin to bind the target antigen. In this way, FR residues can be selected and combined from the recipient and import sequences so that the desired antibody or antibody fragment characteristic, such as increased affinity for the target antigen, is achieved. In general, the CDR residues are directly and most substantially involved in influencing antigen binding.

In one aspect, the antigen binding domain (e.g., the anti-CD70 binding domain) is characterized by particular functional features or properties of an antibody or antibody fragment. For example, in one aspect, the portion of a TFP composition of the present disclosure that comprises an antigen binding domain specifically binds human CD70. In one aspect, the present disclosure relates to an antigen binding domain comprising an antibody or antibody fragment, wherein the antigen binding domain specifically binds to a CD70 protein or fragment thereof, wherein the antibody or antibody fragment comprises a variable light chain and/or a variable heavy chain that includes an amino acid sequence provided herein. In certain aspects, the antigen binding domain (e.g., scFv or a sdAb) is contiguous with and in the same reading frame as a leader sequence.

Also provided herein are methods for obtaining an antibody antigen binding domain specific for a target antigen (e.g., CD70, or any target antigen described elsewhere herein for targets of fusion moiety binding domains), the method comprising providing by way of addition, deletion, substitution or insertion of one or more amino acids in the amino acid sequence of a $V_H$ domain set out herein a $V_H$ domain which is an amino acid sequence variant of the $V_H$ domain, optionally combining the $V_H$ domain thus provided with one or more $V_L$ domains, and testing the $V_H$ domain or $V_H/V_L$ combination or combinations to identify a specific binding member or an antibody antigen binding domain specific for a target antigen of interest (e.g., CD70) and optionally with one or more desired properties.

In some instances, $V_{HH}$ domains and scFvs can be prepared according to method known in the art (see, for example, Bird et al., (1988) Science 242:423-426 and Huston et al., (1988) Proc. Natl. Acad. Sci. USA 85:5879-5883). scFv molecules can be produced by linking $V_H$ and $V_L$ regions together using flexible polypeptide linkers. The scFv molecules comprise a linker (e.g., a Ser-Gly linker) with an optimized length and/or amino acid composition. The linker length can greatly affect how the variable regions of a scFv fold and interact. In fact, if a short polypeptide linker is employed (e.g., between 5-10 amino acids) intra-chain folding is prevented. Inter-chain folding may also be required to bring the two variable regions together to form a functional epitope binding site. In some instances, the linker sequence comprises a long linker (LL) sequence. In some instances, the long linker sequence comprises $(G_4S)_n$, wherein n=2 to 4. In some instances, the linker sequence comprises a short linker (SL) sequence. In some instances, the short linker sequence comprises $(G_4S)_n$, wherein n=1 to 3. For examples of linker orientation and size see, e.g., Hollinger et al. 1993 Proc Natl Acad. Sci. U.S.A. 90:6444-6448, U.S. Pat. No. 7,695,936, U.S. Patent Application Publication Nos. 20050100543 and 20050175606, and PCT Publication Nos. WO2006/020258 and WO2007/024715, all of which are incorporated herein by reference.

A scFv can comprise a linker of about 10, 11, 12, 13, 14, 15 or greater than 15 residues between its $V_L$ and $V_H$ regions. The linker sequence may comprise any naturally occurring amino acid. In some embodiments, the linker sequence comprises amino acids glycine and serine. In another embodiment, the linker sequence comprises sets of glycine and serine repeats such as $(G_4S)_n$, where n is a positive integer equal to or greater than 1. In one embodiment, the linker can be $(G_4S)_4$ or $(G_4S)_3$. Variation in the linker length may retain or enhance activity, giving rise to superior efficacy in activity studies. In some instances, the linker sequence comprises a long linker (LL) sequence. In some instances, the long linker sequence comprises $(G_4S)_n$, wherein n=2 to 4. In some instances, the linker sequence comprises a short linker (SL) sequence. In some instances, the short linker sequence comprises $(G_4S)_n$, wherein n=1 to 3.

The antigen binding domain described herein can be a camelid antibody or binding fragment thereof. The antigen binding domain can be a murine antibody or binding fragment thereof. The antigen binding domain can be a human or humanized antibody or binding fragment thereof. The antigen binding domain can be a single-chain variable fragment (scFv) or a single domain antibody (sdAb) domain. The antigen binding domain can be a single domain antibody (sdAb). The sdAb can be a $V_{HH}$.

The antigen binding domain can bind to human CD70 with a $K_D$ value of at most about 100, 98, 95, 90, 85, 80, 75, 70, 65, 60, 55, 50, 40, 30, 20, 10, 0.5, 0.2, 0.1, 0.05, 0.01, 0.005, 0.001 nM or less. In some cases, the $K_D$ value can be from about 0.001 nM to about 100 nM, from about 0.01 nM to about 10 nM, from about 0.1 nM to about 10 nM, or from about 0.1 nM to about 100 nM. The antigen binding domain may not compete with CD27 for binding to CD70, may not inhibit CD70 from interacting with CD27, and/or may not bind to the same epitope of CD70 to which CD27 binds. The antigen binding domain may compete with CD27 for binding to CD70, inhibit CD70 from interacting with CD27, and/or bind to the same epitope of CD70 to which CD27 binds.

The antigen binding domain comprises a variable domain comprising a complementarity determining region 1 (CDR1), a CDR2, and a CDR3. The CDR1, CDR2, and CDR3 of the antigen binding domain can be selected from the group consisting of:

(i) a CDR1 comprising a sequence of $X_1X_2FX_3IX_4RGX_5$;
a CDR2 comprising a sequence of $AIX_6TSGX_7ATX_8YA$; and
a CDR3 comprising a sequence of $CNMEX_{11}X_{12}X_{13}YRX_{14}YW$;

(ii) a CDR1 comprising a sequence of $X_{15}X_{16}X_{17}X_{18}X_{19}YX_{20}X_{21}X_{22}$;
a CDR2 comprising a sequence of $X_{23}CX_{24}X_{25}SX_{26}X_{27}X_{28}X_{29}X_{30}KYA$; and
a CDR3 comprising a sequence of $CX_{31}AAX_{32}PX_{33}DDCSVX_{34}GX_{35}YGLNYW$;

(iii) a CDR1 comprising a sequence of $X_{36}TFDAYAIG$;
a CDR2 comprising a sequence of ICLSPSDGSTYYA; and
a CDR3 comprising a sequence of $CAX_{37}PSWCSLKADFGSW$;

(iv) a CDR1 comprising a sequence of SIIRDNVMA;
a CDR2 comprising a sequence of $AIINX_{38}GGSX_{39}NVD$; and
a CDR3 comprising a sequence of $CNVYYRX_{40}LW$;

(v) a CDR1 comprising a sequence of SIFSIARMN or FTLDYYAIA;
a CDR2 comprising a sequence of AILNRAGRTDYA; and
a CDR3 comprising a sequence of CNLQTISYHDFW; and (vi) a CDR1 comprising a sequence of SIFSATRME;
a CDR2 comprising a sequence of AIVTSGGRTNYA; and
a CDR3 comprising a sequence of CKFERYDYVNYW;

wherein $X_1$-$X_{39}$ are any naturally occurring amino acid.

In some cases, $X_4$ is a non-polar amino acid; $X_5$ is a polar amino acid; $X_6$ is a non-polar amino acid; $X_{11}$ is a polar amino acid; $X_{12}$ is a non-polar amino acid; $X_{16}$ is a polar amino acid; $X_{18}$ is a negatively charged amino acid; $X_{21}$ is a non-polar amino acid; $X_{24}$ is a non-polar amino acid; $X_{25}$ is a polar amino acid; $X_{29}$ is a non-polar amino acid; and/or $X_{39}$ is a non-polar amino acid.

In some cases, a CDR1 comprises a sequence of $X_1X_2FX_3IX_4RGX_5$, wherein $X_1$ is S or G; $X_2$ is I or T; $X_3$ is D or G; $X_4$ is V or A; and $X_5$ is S or N; a CDR2 comprises a sequence of $AIX_6TSGX_7ATX_8YA$, wherein $X_8$ is I or V; $X_9$ is G or D; and $X_{10}$ is N or D; and a CDR3 comprises a sequence of $CNMEX_{11}X_{12}X_{13}YRX_{14}YW$, wherein $X_{11}$ is S or T; $X_{12}$ is F, V, or L; $X_{13}$ is R or S; and $X_{14}$ is N or H.

In some cases, a CDR1 comprises a sequence of $X_{15}X_{16}X_{17}X_{18}X_{19}YX_{20}X_{21}X_{22}$, wherein $X_{15}$ is F, L, or R; $X_{16}$ is T, S, or N; $X_{17}$ is L, F, or R; $X_{18}$ is D or E; $X_{19}$ is R, H, Y, K, N; $X_{20}$ is S, A, or T; $X_{21}$ is I, V, or M; and $X_{22}$ is G or N; a CDR2 comprises a sequence of $X_{23}CX_{24}X_{25}SX_{26}X_{27}X_{28}X_{29}X_{30}KYA$, wherein $X_{23}$ is S, A, T, or L; $X_{24}$ is I or V; $X_{25}$ is S or T; $X_{26}$ is S, K, or N; $X_{17}$ is G or S; $X_{29}$ is G or D; $X_{29}$ is I, L, or V; and $X_{30}$ is P, T, I, or V; and a CDR3 comprises a sequence of $CX_{31}AAX_{32}PX_{33}DDCSVX_{34}GX_{35}YGLNYW$, wherein $X_{31}$ is G, T, or A; $X_{32}$ is T, G, or D; $X_{33}$ is D, P, A, or K; $X_{34}$ is P, A, or H; and $X_{35}$ is H or Y.

In some cases, a CDR1 comprises a sequence of $X_{36}TFDAYAIG$, wherein $X_{36}$ is F or H; a CDR2 comprising a sequence of ICLSPSDGSTYYA; and a CDR3 comprising a sequence of $CAX_{37}PSWCSLKADFGSW$, wherein $X_{37}$ is T or A; or a CDR1 comprises a sequence of SIIRDNVMA; a CDR2 comprises a sequence of AIINX$_{38}$GGSX$_{39}$NVD, wherein X$_{39}$ is T or I; and X$_{39}$ is A or G; and a CDR3 comprises a sequence of CNVYYRX$_{40}$LW, wherein X$_{40}$ is D or G.

The antigen binding domain can comprise a variable domain having at least 60%, 65%, 70%, 75%, 80%, 855, 90%, 95%, 98%, 99% or 100% sequence identity to any one of SEQ ID NOs: 603-620 or 622-688. The variable domain can have at least 60%, 65%, 70%, 75%, 80%, 855, 90%, 95%, 98%, 99% or 100% sequence identity to any one of SEQ ID NOs: 603-620 or 622-688. The variable domain can comprise the sequence of any one of SEQ ID NOs: 603-620 or 622-688. The variable domain can comprise the sequence of SEQ ID NO: 605. The variable domain can comprise the sequence of SEQ ID NO: 611. The variable domain can comprise the sequence of SEQ ID NO: 613. The variable domain can comprise the sequence of SEQ ID NO: 620. The variable domain can comprise the sequence of SEQ ID NO: 618. The variable domain can comprise the sequence of SEQ ID NO: 603. The variable domain can comprise the sequence of SEQ ID NO: 615. The variable domain can comprise the sequence of SEQ ID NO: 608. The variable domain can comprise the sequence of SEQ ID NO: 610.

The antigen binding domain can comprise a CDR1 comprising a sequence of any one of SEQ ID NOs: 87-104 or 107-172; a CDR2 comprising a sequence of any one of SEQ ID NOs: 259-276 or 279-344; and a CDR3 comprising a sequence of any one of SEQ ID NOs: 431-448 or 451-516. The CDR1 can be SEQ ID NO: 89, CDR2 can be SEQ ID NO: 261 and CDR3 can be SEQ ID NO: 433. The CDR1 can be SEQ ID NO: 95, CDR2 can be SEQ ID NO: 267 and CDR3 can be SEQ ID NO: 439. The CDR1 can be SEQ ID NO: 97, CDR2 can be SEQ ID NO: 269 and CDR3 can be SEQ ID NO: 441. The CDR1 can be SEQ ID NO: 104, CDR2 can be SEQ ID NO: 276 and CDR3 can be SEQ ID NO: 448. The CDR1 can be SEQ ID NO: 102, CDR2 can be SEQ ID NO: 274 and CDR3 can be SEQ ID NO: 446. The CDR1 can be SEQ ID NO: 87, CDR2 can be SEQ ID NO: 259 and CDR3 can be SEQ ID NO: 431. The CDR1 can be SEQ ID NO: 99, CDR2 can be SEQ ID NO: 271 and CDR3 can be SEQ ID NO: 443. The CDR1 can be SEQ ID NO: 92, CDR2 can be SEQ ID NO: 264 and CDR3 can be SEQ ID NO: 436. The CDR1 can be SEQ ID NO: 94, CDR2 can be SEQ ID NO: 266 and CDR3 can be SEQ ID NO: 439.

The antigen binding domain can comprise a variable domain having at least 60%, 65%, 70%, 75%, 80%, 855, 90%, 95%, 98%, 99% or 100% sequence identity to SEQ ID NO: 621. The variable domain can have at least 60%, 65%, 70%, 75%, 80%, 855, 90%, 95%, 98%, 99% or 100% sequence identity to SEQ ID NO: 621. The variable domain can comprise the sequence of SEQ ID NOs: 621. The CDR1 can be SEQ ID NO: 105, CDR2 can be SEQ ID NO: 227 and CDR3 can be SEQ ID NO: 449.

In some cases, the antigen binding domain is a single-chain variable fragment (scFv). The scFv can comprise a heavy chain variable (VH) domain having at least 60%, 65%, 70%, 75%, 80%, 85%, 90%, 95%, 98%, 99% or 100% sequence identity to any one of SEQ ID NOs: 783-835. The scFv can comprise a heavy chain variable (VH) domain having at least 95% sequence identity to any one of SEQ ID NOs: 783-835. The scFv can comprise a heavy chain variable (VH) domain having a sequence of any one of SEQ ID NOs: 783-835.

The scFv can comprise a light chain variable (VL) domain having at least 60%, 65%, 70%, 75%, 80%, 85%, 90%, 95%, 98%, 99% or 100% sequence identity to any one of SEQ ID NOs: 995-1047. The scFv can comprise a light chain variable (VL) domain having at least 95% sequence identity to any one of SEQ ID NOs: 995-1047. The scFv can comprise a light chain variable (VL) domain having a sequence of any one of SEQ ID NOs: 995-1047. The VH domain can comprise a heavy chain complementary determining region 1 (CDRH1) having a sequence of any one of SEQ ID NOs: 836-888, a CDRH2 having a sequence of any one of SEQ ID NOs: 889-941, and a CDRH3 having a sequence of any one of SEQ ID NOs: 942-994. The VL domain can comprise a light chain complementary determining region 1 (CDRL1) having a sequence of any one of SEQ ID NOs: 1048-1100, a CDRL2 having a sequence of any one of SEQ ID NOs: 1101-1153, and a CDRL3 having a sequence of any one of SEQ ID NOs: 1154-1206.

The scFv can comprise a VH domain having at least 60%, 65%, 70%, 75%, 80%, 85%, 90%, 95%, 98%, 99% or 100% sequence identity to SEQ ID NO: 800. The scFv can comprise a $V_H$ domain having at least 95% sequence identity to SEQ ID NO: 800. The scFv can comprise a VH domain having a sequence of SEQ ID NO: 800. The scFv can comprise a VL domain having at least 60%, 65%, 70%, 75%, 80%, 85%, 90%, 95%, 98%, 99% or 100% sequence identity to SEQ ID NO: 1012. The scFv can comprise a VL domain having at least 95% sequence identity to SEQ ID NO: 1012. The scFv can comprise a VL domain having a sequence of SEQ ID NO: 1012. The VH domain can comprise a CDRH1 having a sequence of SEQ ID NO: 853, a CDRH2 having a sequence of SEQ ID NO: 906, and a CDRH3 having a sequence of SEQ ID NO: 959. The VL domain can comprise a CDRL1 having a sequence of SEQ ID NO: 1065, a CDRL2 having a sequence of SEQ ID NO: 1118, and a CDRL3 having a sequence of SEQ ID NO: 1171.

The scFv can comprise a VH domain having at least 60%, 65%, 70%, 75%, 80%, 85%, 90%, 95%, 98%, 99% or 100% sequence identity to SEQ ID NO: 783. The scFv can comprise a VH domain having at least 95% sequence identity to SEQ ID NO: 783. The scFv can comprise a VH domain having a sequence of SEQ ID NO: 783. The scFv can comprise a VL domain having at least 90% sequence identity to SEQ ID NO: 995. The scFv can comprise a VL domain having at least 95% sequence identity to SEQ ID NO: 995. The scFv can comprise a VL domain having a sequence of SEQ ID NO: 995. The VH domain can comprise a CDRH1 having a sequence of SEQ ID NO: 836, a CDRH2 having a sequence of SEQ ID NO: 889, and a CDRH3 having a sequence of SEQ ID NO: 942. The VL domain can comprise a CDRL1 having a sequence of SEQ ID NO: 1048, a CDRL2 having a sequence of SEQ ID NO: 1101, and a CDRL3 having a sequence of SEQ ID NO: 1154.

The scFv can comprise a VH domain having at least 60%, 65%, 70%, 75%, 80%, 85%, 90%, 95%, 98%, 99% or 100% sequence identity to SEQ ID NO: 784. The scFv can comprise a VH domain having at least 95% sequence identity to SEQ ID NO: 784. The scFv can comprise a VH domain having a sequence of SEQ ID NO: 784. The scFv can comprise a VL domain having at least 60%, 65%, 70%, 75%, 80%, 85%, 90%, 95%, 98%, 99% or 100% sequence identity to SEQ ID NO: 996. The scFv can comprise a VL domain having at least 95% sequence identity to SEQ ID NO: 996. The scFv can comprise a VL domain having a sequence of SEQ ID NO: 996. The VH domain can comprise a CDRH1 having a sequence of SEQ ID NO: 837, a CDRH2 having a sequence of SEQ ID NO: 890, and a CDRH3 having a sequence of SEQ ID NO: 943. The VL domain can comprise a CDRL1 having a sequence of SEQ ID NO: 1049, a CDRL2 having a sequence of SEQ ID NO: 1102, and a CDRL3 having a sequence of SEQ ID NO: 1155.

The scFv can comprise a linker sequence. The linker sequence can comprise a sequence of SEQ ID NO: 782.

Stability and Mutations

The stability of an anti-CD70 binding domain, e.g., scFv or sdAb molecules (e.g., soluble scFv or sdAb) can be evaluated in reference to the biophysical properties (e.g., thermal stability) of a conventional control scFv molecule or a full length antibody. In one embodiment, the humanized or human scFv has a thermal stability that is greater than about 0.1, about 0.25, about 0.5, about 0.75, about 1, about 1.25, about 1.5, about 1.75, about 2, about 2.5, about 3, about 3.5, about 4, about 4.5, about 5, about 5.5, about 6, about 6.5, about 7, about 7.5, about 8, about 8.5, about 9, about 9.5, about 10 degrees, about 11 degrees, about 12 degrees, about 13 degrees, about 14 degrees, or about 15 degrees Celsius than a parent scFv in the described assays.

The improved thermal stability of the anti-CD70 binding domain, e.g., scFv is subsequently conferred to the entire anti-CD70 TFP construct, leading to improved therapeutic properties of the anti-CD70 TFP construct. The thermal stability of the anti-CD70 binding domain, e.g., scFv can be improved by at least about 2° C. or 3° C. as compared to a conventional antibody. In one embodiment, the anti-CD70 binding domain, e.g., scFv has a 1° C. improved thermal stability as compared to a conventional antibody. In another embodiment, the anti-CD70 binding domain, e.g., scFv has a 2° C. improved thermal stability as compared to a conventional antibody. In another embodiment, the scFv has a 4° C., 5° C., 6° C., 7° C., 8° C., 9° C., 10° C., 11° C., 12° C., 13° C., 14° C., or 15° C. improved thermal stability as compared to a conventional antibody. Comparisons can be made, for example, between the scFv molecules disclosed herein and scFv molecules or Fab fragments of an antibody from which the scFv $V_H$ and $V_L$ were derived. Thermal stability can be measured using methods known in the art. For example, in one embodiment, TM can be measured. Methods for measuring TM and other methods of determining protein stability are described below.

Mutations in the antigen binding domain such as scFv or sdAb (arising through humanization or mutagenesis of the soluble scFv or sdAb) alter the stability of the antigen binding domain and improve the overall stability of the antigen binding domain and the anti-CD70 TFP construct. Stability of the humanized antigen binding domain can be compared against the murine antigen binding domain using measurements such as TM, temperature denaturation and temperature aggregation. In one embodiment, the antigen binding domain, e.g., a scFv or sdAb, can comprise at least one mutation arising from the humanization process such that the mutated antigen binding domain confers improved stability to the anti-CD70 TFP construct. In another embodiment, the anti-CD70 binding domain, e.g., scFv or sdAb, comprises at least 1, 2, 3, 4, 5, 6, 7, 8, 9, 10 mutations arising from the humanization process such that the mutated antigen binding domain confers improved stability to the anti-CD70 TFP construct.

In one aspect, the antigen binding domain of the TFP comprises an amino acid sequence that is homologous to an antigen binding domain amino acid sequence described herein, and the antigen binding domain retains the desired functional properties of the anti-CD70 antibody fragments described herein. In one specific aspect, the TFP composition of the invention comprises an antibody fragment. In a further aspect, that antibody fragment comprises a scFv or sdAb.

In various aspects, the antigen binding domain of the TFP is engineered by modifying one or more amino acids within one or both variable regions (e.g., $V_H$ and/or $V_L$), for example within one or more CDR regions and/or within one or more framework regions. In one specific aspect, the TFP composition of the present disclosure comprises an antibody fragment. In a further aspect, that antibody fragment comprises a scFv or sdAb.

It will be understood by one of ordinary skill in the art that the antibody or antibody fragment of the present disclosure may further be modified such that they vary in amino acid sequence (e.g., from wild-type), but not in desired activity. For example, additional nucleotide substitutions leading to amino acid substitutions at “non-essential” amino acid residues may be made to the protein. For example, a nonessential amino acid residue in a molecule may be replaced with another amino acid residue from the same side chain family. In another embodiment, a string of amino acids can be replaced with a structurally similar string that differs in order and/or composition of side chain family members, e.g., a conservative substitution, in which an amino acid residue is replaced with an amino acid residue having a similar side chain, may be made.

Families of amino acid residues having similar side chains have been defined in the art, including basic side chains (e.g., lysine, arginine, histidine), acidic side chains (e.g., aspartic acid, glutamic acid), uncharged polar side chains (e.g., glycine, asparagine, glutamine, serine, threonine, tyrosine, cysteine), nonpolar side chains (e.g., alanine, valine, leucine, isoleucine, proline, phenylalanine, methionine, tryptophan), beta-branched side chains (e.g., threonine, valine, isoleucine) and aromatic side chains (e.g., tyrosine, phenylalanine, tryptophan, histidine).

Percent identity in the context of two or more nucleic acids or polypeptide sequences refers to two or more sequences that are the same. Two sequences are “substantially identical” if two sequences have a specified percentage of amino acid residues or nucleotides that are the same (e.g., 60% identity, optionally 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% identity over a specified region, or, when not specified, over the entire sequence), when compared and aligned for maximum correspondence over a comparison window, or designated region as measured using one of the following sequence comparison algorithms or by manual alignment and visual inspection. Optionally, the identity exists over a region that is at least about 50 nucleotides (or 10 amino acids) in length, or more preferably over a region that is 100 to 500 or 1000 or more nucleotides (or 20, 50, 200 or more amino acids) in length.

For sequence comparison, typically one sequence acts as a reference sequence, to which test sequences are compared. When using a sequence comparison algorithm, test and reference sequences are entered into a computer, subsequence coordinates are designated, if necessary, and sequence algorithm program parameters are designated. Default program parameters can be used, or alternative parameters can be designated. The sequence comparison algorithm then calculates the percent sequence identities for the test sequences relative to the reference sequence, based on the program parameters. Methods of alignment of sequences for comparison are well known in the art. Optimal alignment of sequences for comparison can be conducted, e.g., by the local homology algorithm of Smith and Waterman, (1970) Adv. Appl. Math. 2:482c, by the homology alignment algorithm of Needleman and Wunsch, (1970) J.

Mol. Biol. 48:443, by the search for similarity method of Pearson and Lipman, (1988) Proc. Nat'l. Acad. Sci. USA 85:2444, by computerized implementations of these algorithms (GAP, BESTFIT, FASTA, and TFASTA in the Wisconsin Genetics Software Package, Genetics Computer Group, 575 Science Dr., Madison, Wis.), or by manual alignment and visual inspection (see, e.g., Brent et al., (2003) Current Protocols in Molecular Biology). Two examples of algorithms that are suitable for determining percent sequence identity and sequence similarity are the BLAST and BLAST 2.0 algorithms, which are described in Altschul et al., (1977) Nuc. Acids Res. 25:3389-3402; and Altschul et al., (1990) J. Mol. Biol. 215:403-410, respectively. Software for performing BLAST analyses is publicly available through the National Center for Biotechnology Information. The algorithm parameters for using nucleotide BLAST to determine nucleotide sequence identity may use scoring parameters with a match/mismatch score of 1,−2 and wherein the gap costs are linear. The length of the sequence that initiates an alignment or the word size in a BLAST algorithm may be set to 28 for sequence alignment. The algorithm parameters for using protein BLAST to determine a peptide sequence identity may use scoring parameters with a BLOSUM62 matrix to assign a score for aligning pairs of residues, and determining overall alignment score, wherein the gap costs may have an existence penalty of 11 and an extension penalty of 1. The matrix adjustment method to compensate for amino acid composition of sequences may be a conditional compositional score matrix adjustment. The length of the sequence that initiates an alignment or the word size in a BLAST algorithm may be set to 6 for sequence alignment.

In an aspect, the present disclosure contemplates modifications of a starting antibody or fragment (e.g., scFv or VHH) amino acid sequence that generates functionally equivalent molecules. For example, the $V_H$ or $V_L$ of a binding domain, e.g., scFv or VHH, comprised in the TFP can be modified to retain at least about 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% identity of the starting $V_H$ or $V_L$ framework region of the anti-CD70 binding domain, e.g., scFv or VHH. The present disclosure contemplates modifications of the entire TFP construct, e.g., modifications in one or more amino acid sequences of the various domains of the TFP construct in order to generate functionally equivalent molecules. The TFP construct can be modified to retain at least about 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% identity of the starting TFP construct.

In some embodiments, the CD70 binder comprises a sequence having at least about 50%, 55%, 60%, 65%, 70%, 75%, 80%, 85%, 90%, 95%, 98%, 99% or more sequence identity to any one of the sequences listed in Tables 5, 7, 8, and 9. In some embodiments, the CD70 binder comprises any one of the sequences listed in Tables 5, 7, 8, and 9.

Extracellular Domain

The extracellular domain may be derived either from a natural or from a recombinant source. Where the source is natural, the domain may be derived from any protein, but in particular a membrane-bound or transmembrane protein. In one aspect the extracellular domain is capable of associating with the transmembrane domain. An extracellular domain of particular use in this present disclosure may include at least the extracellular region(s) of e.g., the alpha, beta, gamma, or delta chain of the T cell receptor, or CD3 epsilon, CD3 gamma, or CD3 delta, or in alternative embodiments, CD28, CD45, CD4, CD5, CD8, CD9, CD16, CD22, CD33, CD37, CD64, CD80, CD86, CD134, CD137, CD154. In some instances, the TCR extracellular domain comprises an extracellular domain or portion thereof of a protein selected from the group consisting of a TCR alpha chain, a TCR beta chain, a TCR gamma chain, a TCR delta chain, a CD3 epsilon TCR subunit, a CD3 gamma TCR subunit, a CD3 delta TCR subunit, functional fragments thereof, and amino acid sequences thereof having at least one but not more than 20 modifications.

In some embodiments, the TCR extracellular domain comprises an extracellular domain or portion thereof of a TCR alpha chain, a TCR beta chain, a TCR delta chain, or a TCR gamma chain. In some embodiments, the TCR extracellular domain comprises an IgC domain of a TCR alpha chain, a TCR beta chain, a TCR delta chain, or a TCR gamma chain.

In some embodiments, the extracellular domain comprises, or comprises at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100 or more consecutive amino acid residues of the extracellular domain of a TCR alpha chain, a TCR beta chain, a TCR delta chain, or a TCR gamma chain. In some embodiments, the extracellular domain comprises a sequence having at least about 50%, 55%, 60%, 65%, 70%, 75%, 80%, 85%, 90%, 95%, 98%, 99% or more sequence identity to a sequence encoding the extracellular domain of a TCR alpha chain, a TCR beta chain, a TCR delta chain, or a TCR gamma chain. In some embodiments, the extracellular domain comprises a sequence encoding the extracellular domain of a TCR alpha chain, a TCR beta chain, a TCR delta chain, or a TCR gamma chain having a truncation of at least 1, 2, 3, 4, 5, 6, 7, 8, 9, 10, 11, 12, 13, 14, 15, 16, 17, 18, 19, 20, 21, 22, 23, 24, 25 or more amino acids at the N- or C-terminus or at both the N- and C-terminus.

In some embodiments, the extracellular domain comprises, or comprises at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100 or more consecutive amino acid residues of an IgC domain of TCR alpha, a TCR beta, a TCR delta, or a TCR gamma. In some embodiments, the extracellular domain comprises a sequence having at least about 50%, 55%, 60%, 65%, 70%, 75%, 80%, 85%, 90%, 95%, 98%, 99% or more sequence identity to a sequence encoding an IgC domain of TCR alpha, a TCR beta, a TCR delta, or a TCR gamma. In some embodiments, the extracellular domain comprises a sequence encoding an IgC domain of TCR alpha, TCR beta, TCR delta, or TCR gamma having a truncation of at least 1, 2, 3, 4, 5, 6, 7, 8, 9, 10, 11, 12, 13, 14, 15, 16, 17, 18, 19, 20, 21, 22, 23, 24, 25 or more amino acids at the N- or C-terminus or at both the N- and C-terminus.

In some embodiments, the extracellular domain comprises, or comprises at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100 or more consecutive amino acid residues of the extracellular domain of a CD3 epsilon TCR subunit, a CD3 gamma TCR subunit, or a CD3 delta TCR subunit. In some embodiments, the extracellular domain comprises a sequence having at least about 50%, 55%, 60%, 65%, 70%, 75%, 80%, 85%, 90%, 95%, 98%, 99% or more sequence identity to a sequence encoding the extracellular domain of a CD3 epsilon TCR subunit, a CD3 gamma TCR subunit, or a CD3 delta TCR subunit. In some embodiments, the extracellular domain comprises a sequence encoding the extracellular domain of a CD3 epsilon TCR subunit, a CD3 gamma TCR subunit, or a CD3 delta TCR subunit having a truncation of at least 1, 2, 3, 4, 5, 6, 7, 8, 9, 10, 11, 12, 13, 14, 15, 16, 17, 18, 19, 20, 21, 22, 23, 24, 25 or more amino acids at the N- or C-terminus or at both the N- and C-terminus.

Transmembrane Domain

In general, a TFP sequence contains an extracellular domain and a transmembrane domain encoded by a single genomic sequence. In alternative embodiments, a TFP can be designed to comprise a transmembrane domain that is heterologous to the extracellular domain of the TFP. A transmembrane domain can include one or more additional amino acids adjacent to the transmembrane region, e.g., one or more amino acid associated with the extracellular region of the protein from which the transmembrane was derived (e.g., at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, or more amino acids of the extracellular region) and/or one or more additional amino acids associated with the intracellular region of the protein from which the transmembrane protein is derived (e.g., 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, or more amino acids of the intracellular region). In some cases, the transmembrane domain can include at least 30, 35, 40, 45, 50, 55, 60 or more amino acids of the extracellular region. In some cases, the transmembrane domain can include at least 30, 35, 40, 45, 50, 55, 60 or more amino acids of the intracellular region. In one aspect, the transmembrane domain is one that is associated with one of the other domains of the TFP is used. In some instances, the transmembrane domain can be selected or modified by amino acid substitution to avoid binding of such domains to the transmembrane domains of the same or different surface membrane proteins, e.g., to minimize interactions with other members of the receptor complex. In one aspect, the transmembrane domain is capable of homodimerization with another TFP on the TFP-T cell surface. In a different aspect the amino acid sequence of the transmembrane domain may be modified or substituted so as to minimize interactions with the binding domains of the native binding partner present in the same TFP.

The transmembrane domain may be derived either from a natural or from a recombinant source. Where the source is natural, the domain may be derived from any membrane-bound or transmembrane protein. In one aspect the transmembrane domain is capable of signaling to the intracellular domain(s) whenever the TFP has bound to a target. In some instances, the TCR-integrating subunit comprises a transmembrane domain comprising a transmembrane domain of a protein selected from the group consisting of a TCR alpha chain, a TCR beta chain, a TCR gamma chain, a TCR delta chain, a TCR zeta chain, a CD3 epsilon TCR subunit, a CD3 gamma TCR subunit, a CD3 delta TCR subunit, CD45, CD4, CD5, CD8, CD9, CD16, CD22, CD33, CD28, CD37, CD64, CD80, CD86, CD134, CD137, CD154, functional fragments thereof, and amino acid sequences thereof having at least one but not more than 20 modifications.

In some embodiments, the transmembrane domain comprises, or comprises at least 5, 6, 7, 8, 9, 10, 11, 12, 13, 14, 15, 16, 17, 18, 19, 20, 21, 22, 23, 24, 25, 26, 27, 28, 29, or 30 or more consecutive amino acid residues of the transmembrane domain of a TCR alpha chain, a TCR beta chain, a TCR gamma chain, a TCR delta chain, a CD3 epsilon TCR subunit, a CD3 gamma TCR subunit, or a CD3 delta TCR subunit. In some embodiments, the transmembrane domain comprises a sequence having at least about 50%, 55%, 60%, 65%, 70%, 75%, 80%, 85%, 90%, 95%, 98%, 99% or more sequence identity to a sequence encoding the transmembrane domain of a TCR alpha chain, a TCR beta chain, a TCR gamma chain, a TCR delta chain, a CD3 epsilon TCR subunit, a CD3 gamma TCR subunit, or a CD3 delta TCR subunit. In some embodiments, the transmembrane domain comprises a sequence encoding the transmembrane domain of a TCR alpha chain, a TCR beta chain, a TCR gamma chain, a TCR delta chain, a CD3 epsilon TCR subunit, a CD3 gamma TCR subunit, or a CD3 delta TCR subunit having a truncation of at least 1, 2, 3, 4, 5, 6, 7, 8, 9, or 10 or more amino acids at the N- or C-terminus or at both the N- and C-terminus.

In some instances, the transmembrane domain can be attached to the extracellular region of the TFP, e.g., the antigen binding domain of the TFP, via a hinge, e.g., a hinge from a human protein. For example, in one embodiment, the hinge can be a human immunoglobulin (Ig) hinge, e.g., an IgG4 hinge, or a CD8a hinge.

Linkers

Optionally, a short oligo- or polypeptide linker, between 2 and 10 amino acids in length may form the linkage between the binding element and the TCR extracellular domain of the TFP. A glycine-serine doublet provides a particularly suitable linker. In some cases, the linker may be at least about 5, 6, 7, 8, 9, 10, 11, 12, 13, 14, 15, 16, 17, 18, 19, 20, or more in length. For example, in one aspect, the linker comprises the amino acid sequence of GGGGSGGGGS (SEQ ID NO: 690) or a sequence (GGGGS (SEQ ID NO: 1232))x wherein X is 1, 2, 3, 4, 5, 6, 7, 8, 9, or 10 or more. In some embodiments, X is 2. In some embodiments, X is 4. In some embodiments, the linker is encoded by a nucleotide sequence of GGTGGCG-GAGGTTCTGGAGGTGGAGGTTCC (SEQ ID NO: 691).

Cytoplasmic Domain

The cytoplasmic domain of the TFP can include an intracellular domain. In some embodiments, the intracellular domain is from CD3 gamma, CD3 delta, CD3 epsilon, TCR alpha, TCR beta, TCR gamma, or TCR delta. In some embodiments, the intracellular domain comprises a signaling domain, if the TFP contains CD3 gamma, delta or epsilon polypeptides; TCR alpha, TCR beta, TCR gamma, and TCR delta subunits generally have short (e.g., 1-19 amino acids in length) intracellular domains and are generally lacking in a signaling domain. An intracellular signaling domain is generally responsible for activation of at least one of the normal effector functions of the immune cell in which the TFP has been introduced. While the intracellular domains of TCR alpha, TCR beta, TCR gamma, and TCR delta do not have signaling domains, they are able to recruit proteins having a primary intracellular signaling domain described herein, e.g., CD3 zeta, which functions as an intracellular signaling domain. The term "effector function" refers to a specialized function of a cell. Effector function of a T cell, for example, may be cytolytic activity or helper activity including the secretion of cytokines. Thus the term "intracellular signaling domain" refers to the portion of a protein which transduces the effector function signal and directs the cell to perform a specialized function. While usually the entire intracellular signaling domain can be employed, in many cases it is not necessary to use the entire chain. To the extent that a truncated portion of the intracellular signaling domain is used, such truncated portion may be used in place of the intact chain as long as it transduces the effector function signal. The term intracellular signaling domain is thus meant to include any truncated portion of the intracellular signaling domain sufficient to transduce the effector function signal.

Examples of intracellular domains for use in the TFP of the present disclosure include the cytoplasmic sequences of the T cell receptor (TCR) and co-receptors that are able to act in concert to initiate signal transduction following antigen receptor engagement, as well as any derivative or variant of these sequences and any recombinant sequence that has the same functional capability.

In some embodiments, the intracellular domain comprises the intracellular domain of a TCR alpha chain, a TCR beta chain, a TCR gamma chain, a TCR delta chain, a CD3 epsilon TCR subunit, a CD3 gamma TCR subunit, or a CD3 delta TCR subunit.

In some embodiments, the intracellular domain comprises, or comprises at least 1, 2, 3, 4, 5, 6, 7, 8, 9, 10, 11, 12, 13, 14, 15, 16, 17, 18, or 19 or more consecutive amino acid residues of the intracellular domain of a TCR alpha chain, a TCR beta chain, a TCR gamma chain, or a TCR delta chain. In some embodiments, the intracellular domain comprises a sequence having at least about 50%, 55%, 60%, 65%, 70%, 75%, 80%, 85%, 90%, 95%, 98%, 99% or more sequence identity to a sequence encoding the intracellular domain of a TCR alpha chain, a TCR beta chain, a TCR gamma chain, or a TCR delta chain. In some embodiments, the transmembrane domain comprises a sequence encoding the intracellular domain of a TCR alpha chain, a TCR beta chain, a TCR gamma chain, or a TCR delta chain having a truncation of at least 1, 2, 3, 4, 5, 6, 7, 8, 9, or 10 or more amino acids at the N- or C-terminus or at both the N- and C-terminus.

In some embodiments, the intracellular domain comprises, or comprises at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, or 62 or more consecutive amino acid residues of the intracellular domain of a CD3 epsilon TCR subunit, a CD3 gamma TCR subunit, or a CD3 delta TCR subunit. In some embodiments, the intracellular domain comprises a sequence having at least about 50%, 55%, 60%, 65%, 70%, 75%, 80%, 85%, 90%, 95%, 98%, 99% or more sequence identity to a sequence encoding the intracellular domain of a CD3 epsilon TCR subunit, a CD3 gamma TCR subunit, or a CD3 delta TCR subunit. In some embodiments, the intracellular domain comprises a sequence encoding the intracellular domain of a CD3 epsilon TCR subunit, a CD3 gamma TCR subunit, or a CD3 delta TCR subunit having a truncation of at least 1, 2, 3, 4, 5, 6, 7, 8, 9, 10, 11, 12, 13, 14, 15, 16, 17, 18, 19, 20, 21, 22, 23, 24, 25 or more amino acids at the N- or C-terminus or at both the N- and C-terminus.

It is known that signals generated through the TCR alone are insufficient for full activation of naive T cells and that a secondary and/or costimulatory signal is required. Thus, naïve T cell activation can be said to be mediated by two distinct classes of cytoplasmic signaling sequences: those that initiate antigen-dependent primary activation through the TCR (primary intracellular signaling domains) and those that act in an antigen-independent manner to provide a secondary or costimulatory signal (secondary cytoplasmic domain, e.g., a costimulatory domain).

A primary signaling domain regulates primary activation of the TCR complex either in a stimulatory way, or in an inhibitory way. Primary intracellular signaling domains that act in a stimulatory manner may contain signaling motifs which are known as immunoreceptor tyrosine-based activation motifs (ITAMs).

Examples of ITAMs containing primary intracellular signaling domains that are of particular use in the present disclosure include those of CD3 zeta, FcR gamma, FcR beta, CD3 gamma, CD3 delta, CD3 epsilon, CD5, CD22, CD79a, CD79b, and CD66d. In one embodiment, a TFP of the present disclosure comprises an intracellular signaling domain, e.g., a primary signaling domain of CD3 epsilon, CD3 delta, or CD3 gamma. In one embodiment, a primary signaling domain comprises a modified ITAM domain, e.g., a mutated ITAM domain which has altered (e.g., increased or decreased) activity as compared to the native ITAM domain. In one embodiment, a primary signaling domain comprises a modified ITAM-containing primary intracellular signaling domain, e.g., an optimized and/or truncated ITAM-containing primary intracellular signaling domain. In an embodiment, a primary signaling domain comprises one, two, three, four or more ITAM motifs.

The intracellular signaling domain of the TFP can comprise a CD3 signaling domain, e.g., CD3 epsilon, CD3 delta, CD3 gamma, or CD3 zeta, by itself or it can be combined with any other desired intracellular signaling domain(s) useful in the context of a TFP of the present disclosure. For example, the intracellular signaling domain of the TFP can comprise a CD3 epsilon chain portion and a costimulatory signaling domain. The costimulatory signaling domain refers to a portion of the TFP comprising the intracellular domain of a costimulatory molecule. A costimulatory molecule is a cell surface molecule other than an antigen receptor or its ligands that is required for an efficient response of lymphocytes to an antigen. Examples of such molecules include CD27, CD28, 4-1BB (CD137), OX40, CD30, CD40, PD1, ICOS, lymphocyte function-associated antigen-1 (LFA-1), CD2, CD7, LIGHT, NKG2C, B7-H3, and a ligand that specifically binds with CD83, and the like. For example, CD27 costimulation has been demonstrated to enhance expansion, effector function, and survival of human TFP-T cells in vitro and augments human T cell persistence and antitumor activity in vivo (Song et al., Blood. 2012; 119(3):696-706).

In some embodiments, the extracellular, transmembrane, and intracellular domain of the TFP are derived from TCR alpha, TCR beta, TCR gamma, or TCR delta and the extracellular, transmembrane, and intracellular domain comprises a constant domain of TCR alpha, TCR beta, TCR gamma, or TCR delta. The TFP can comprise a full-length constant domain of a TCR alpha chain, a TCR beta chain, a TCR gamma chain or a TCR delta chain. The TFP can comprise a fragment (e.g., functional fragment) of the full-length constant domain of a TCR alpha chain, a TCR beta chain, a TCR gamma chain or a TCR delta chain.

The TCR alpha chain, a TCR beta chain, a TCR gamma chain or a TCR delta chain described herein can be derived from various species. The TCR chain can be a murine or human TCR chain. For example, the TFP can comprise a constant domain of a murine TCR alpha chain, a murine TCR beta chain, a human TCR gamma chain or a human TCR delta chain.

The intracellular signaling sequences within the cytoplasmic portion of the TFP of the present disclosure may be linked to each other in a random or specified order. Optionally, a short oligo- or polypeptide linker, for example, between 2 and 10 amino acids (e.g., 2, 3, 4, 5, 6, 7, 8, 9, or 10 amino acids) in length may form the linkage between intracellular signaling sequences.

In one embodiment, a glycine-serine doublet can be used as a suitable linker. In one embodiment, a single amino acid, e.g., an alanine, a glycine, can be used as a suitable linker.

In one aspect, the TFP-expressing cell described herein can further comprise a second TFP, e.g., a second TFP that includes a different antigen binding domain, e.g., to the same target (e.g., CD70) or a different target (e.g., MSLN, CD19, or MUC16). In one embodiment, when the TFP- expressing cell comprises two or more different TFPs, the antigen binding domains of the different TFPs can be such that the antigen binding domains do not interact with one another. For example, a cell expressing a first and second TFP can have an antigen binding domain of the first TFP, e.g., as a fragment, e.g., a scFv, that does not form an association with the antigen binding domain of the second TFP, e.g., the antigen binding domain of the second TFP is a $V_{HH}$.

In another aspect, the TFP-expressing cell described herein can further express another agent, e.g., an agent which enhances the activity of a modified T cell. For example, in one embodiment, the agent can be an agent which inhibits an inhibitory molecule. Inhibitory molecules, e.g., PD1, can, in some embodiments, decrease the ability of a modified T cell to mount an immune effector response. Examples of inhibitory molecules include PD1, PD-L1, CTLA4, TIM3, LAG3, VISTA, BTLA, TIGIT, LAIR1, CD160, 2B4 and TGFR beta. In one embodiment, the agent which inhibits an inhibitory molecule comprises a first polypeptide, e.g., an inhibitory molecule, associated with a second polypeptide that provides a positive signal to the cell, e.g., an intracellular signaling domain described herein. In one embodiment, the agent comprises a first polypeptide, e.g., of an inhibitory molecule such as PD1, LAG3, CTLA4, CD160, BTLA, LAIR1, TIM3, 2B4 and TIGIT, or a fragment of any of these (e.g., at least a portion of an extracellular domain of any of these), and a second polypeptide which is an intracellular signaling domain described herein (e.g., comprising a costimulatory domain (e.g., 4-1BB, CD27 or CD28, e.g., as described herein) and/or a primary signaling domain (e.g., a CD3 zeta signaling domain described herein). In one embodiment, the agent comprises a first polypeptide of PD1 or a fragment thereof (e.g., at least a portion of an extracellular domain of PD1), and a second polypeptide of an intracellular signaling domain described herein (e.g., a CD28 signaling domain described herein and/or a CD3 zeta signaling domain described herein). PD1 is an inhibitory member of the CD28 family of receptors that also includes CD28, CTLA-4, ICOS, and BTLA. PD-1 is expressed on activated B cells, T cells and myeloid cells (Agata et al., 1996, *Int. Immunol* 8:765-75). Two ligands for PD1, PD-L1 and PD-L2, have been shown to downregulate T cell activation upon binding to PD1 (Freeman et al., 2000 J. *Exp. Med.* 192:1027-34; Latchman et al., 2001 *Nat. Immunol.* 2:261-8; Carter et al., 2002 *Eur. J. Immunol.* 32:634-43). PD-L1 is abundant in human cancers (Dong et al., 2003 *J. Mol. Med.* 81:281-7; Blank et al., 2005 *Cancer Immunol. Immunother.* 54:307-314; Konishi et al., 2004 *Clin. Cancer Res.* 10:5094). Immune suppression can be reversed by inhibiting the local interaction of PD1 with PD-L1.

In one embodiment, the agent comprises the extracellular domain (ECD) of an inhibitory molecule, e.g., Programmed Death 1 (PD1) can be fused to a transmembrane domain and optionally an intracellular signaling domain such as 41BB and CD3 zeta (also referred to herein as a PD1 TFP). In one embodiment, the PD1 TFP, when used in combinations with an anti-CD70 TFP described herein, improves the persistence of the T cell. In one embodiment, the TFP is a PD1 TFP comprising the extracellular domain of PD-1. Alternatively, provided are TFPs containing an antibody or antibody fragment such as a scFv that specifically binds to the Programmed Death-Ligand 1 (PD-L1) or Programmed Death-Ligand 2 (PD-L2).

In another aspect, the present disclosure provides a population of TFP-expressing T cells, e.g., TFP-T cells. In some embodiments, the population of TFP-expressing T cells comprises a mixture of cells expressing different TFPs. For example, in one embodiment, the population of TFP- T cells can include a first cell expressing a TFP having an anti-CD70 binding domain described herein, and a second cell expressing a TFP having a binding domain specifically targeting a different antigen, e.g., a binding domain described herein that differs from the anti-CD70 binding domain in the TFP expressed by the first cell. As another example, the population of TFP-expressing cells can include a first cell expressing a TFP that includes a first binding domain binding domain, e.g., as described herein, and a second cell expressing a TFP that includes an antigen binding domain to a target other than the binding domain of the first cell (e.g., another tumor-associated antigen).

In another aspect, the present disclosure provides a population of cells wherein at least one cell in the population expresses a TFP having a domain described herein, and a second cell expressing another agent, e.g., an agent which enhances the activity of a modified T cell. For example, in one embodiment, the agent can be an agent which inhibits an inhibitory molecule. Inhibitory molecules, e.g., can, in some embodiments, decrease the ability of a modified T cell to mount an immune effector response. Examples of inhibitory molecules include PD1, PD-L1, PD-L2, CTLA4, TIM3, LAG3, VISTA, BTLA, TIGIT, LAIR1, CD160, 2B4 and TGFR beta. In one embodiment, the agent that inhibits an inhibitory molecule comprises a first polypeptide, e.g., an inhibitory molecule, associated with a second polypeptide that provides a positive signal to the cell, e.g., an intracellular signaling domain described herein. In some embodiments, the agent is a cytokine. In some embodiments, the cytokine is IL-15. In some embodiments, IL-15 increases the persistence of the T cells described herein.

Recombinant Nucleic Acids Encoding a TFP

Disclosed herein, in some embodiments, are recombinant nucleic acids encoding the TFPs disclosed herein.

In some instances, the recombinant nucleic acid further comprises a leader sequence. In some instances, the recombinant nucleic acid further comprises a promoter sequence. In some instances, the recombinant nucleic acid further comprises a sequence encoding a poly(A) tail. In some instances, the recombinant nucleic acid further comprises a 3'UTR sequence. In some instances, the nucleic acid is an isolated nucleic acid or a non-naturally occurring nucleic acid. Non-naturally occurring nucleic acids are well known to those of skill in the art. In some instances, the nucleic acid is an in vitro transcribed nucleic acid.

Disclosed herein are methods for producing in vitro transcribed RNA encoding TFPs. The present disclosure also includes a TFP encoding RNA construct that can be directly transfected into a cell. A method for generating mRNA for use in transfection can involve in vitro transcription (IVT) of a template with specially designed primers, followed by polyA addition, to produce a construct containing 3' and 5' untranslated sequence ("UTR"), a 5' cap and/or Internal Ribosome Entry Site (IRES), the nucleic acid to be expressed, and a polyA tail, typically 50-2000 bases in length. RNA so produced can efficiently transfect different kinds of cells. In one aspect, the template includes sequences for the TFP.

In one aspect the anti-CD70 TFP is encoded by a messenger RNA (mRNA). In one aspect the mRNA encoding the anti-CD70 TFP is introduced into a T cell for production of a TFP-T cell. In one embodiment, the in vitro transcribed RNA TFP can be introduced to a cell as a form of transient transfection. The RNA is produced by in vitro transcription using a polymerase chain reaction (PCR)-generated template. DNA of interest from any source can be directly converted by PCR into a template for in vitro mRNA synthesis using appropriate primers and RNA polymerase. The source of the DNA can be, for example, genomic DNA, plasmid DNA, phage DNA, cDNA, synthetic DNA sequence or any other appropriate source of DNA. The desired template for in vitro transcription is a TFP of the present disclosure. In one embodiment, the DNA to be used for PCR contains an open reading frame. The DNA can be from a naturally occurring DNA sequence from the genome of an organism. In one embodiment, the nucleic acid can include some or all of the 5' and/or 3' untranslated regions (UTRs). The nucleic acid can include exons and introns. In one embodiment, the DNA to be used for PCR is a human nucleic acid sequence. In another embodiment, the DNA to be used for PCR is a human nucleic acid sequence including the 5' and 3' UTRs. The DNA can alternatively be an artificial DNA sequence that is not normally expressed in a naturally occurring organism. An exemplary artificial DNA sequence is one that contains portions of genes that are ligated together to form an open reading frame that encodes a fusion protein. The portions of DNA that are ligated together can be from a single organism or from more than one organism.

PCR is used to generate a template for in vitro transcription of mRNA which is used for transfection. Methods for performing PCR are well known in the art. Primers for use in PCR are designed to have regions that are substantially complementary to regions of the DNA to be used as a template for the PCR. "Substantially complementary," as used herein, refers to sequences of nucleotides where a majority or all of the bases in the primer sequence are complementary, or one or more bases are non-complementary, or mismatched. Substantially complementary sequences are able to anneal or hybridize with the intended DNA target under annealing conditions used for PCR. The primers can be designed to be substantially complementary to any portion of the DNA template. For example, the primers can be designed to amplify the portion of a nucleic acid that is normally transcribed in cells (the open reading frame), including 5' and 3' UTRs. The primers can also be designed to amplify a portion of a nucleic acid that encodes a particular domain of interest. In one embodiment, the primers are designed to amplify the coding region of a human cDNA, including all or portions of the 5' and 3' UTRs. Primers useful for PCR can be generated by synthetic methods that are well known in the art. "Forward primers" are primers that contain a region of nucleotides that are substantially complementary to nucleotides on the DNA template that are upstream of the DNA sequence that is to be amplified. "Upstream" is used herein to refer to a location 5, to the DNA sequence to be amplified relative to the coding strand. "Reverse primers" are primers that contain a region of nucleotides that are substantially complementary to a double-stranded DNA template that are downstream of the DNA sequence that is to be amplified. "Downstream" is used herein to refer to a location 3' to the DNA sequence to be amplified relative to the coding strand.

Any DNA polymerase useful for PCR can be used in the methods disclosed herein. The reagents and polymerase are commercially available from a number of sources.

Chemical structures with the ability to promote stability and/or translation efficiency may also be used. The RNA preferably has 5' and 3' UTRs. In one embodiment, the 5' UTR is between one and 3,000 nucleotides in length. The length of 5' and 3' UTR sequences to be added to the coding region can be altered by different methods, including, but not limited to, designing primers for PCR that anneal to different regions of the UTRs. Using this approach, one of ordinary skill in the art can modify the 5' and 3' UTR lengths that can be used to achieve optimal translation efficiency following transfection of the transcribed RNA.

The 5' and 3' UTRs can be the naturally occurring, endogenous 5' and 3' UTRs for the nucleic acid of interest. Alternatively, UTR sequences that are not endogenous to the nucleic acid of interest can be added by incorporating the UTR sequences into the forward and reverse primers or by any other modifications of the template. The use of UTR sequences that are not endogenous to the nucleic acid of interest can be useful for modifying the stability and/or translation efficiency of the RNA. For example, it is known that AU-rich elements in 3'UTR sequences can decrease the stability of mRNA. Therefore, 3' UTRs can be selected or designed to increase the stability of the transcribed RNA based on properties of UTRs that are well known in the art.

In one embodiment, the 5' UTR can contain the Kozak sequence of the endogenous nucleic acid. Alternatively, when a 5' UTR that is not endogenous to the nucleic acid of interest is being added by PCR as described above, a consensus Kozak sequence can be redesigned by adding the 5' UTR sequence. Kozak sequences can increase the efficiency of translation of some RNA transcripts, but does not appear to be required for all RNAs to enable efficient translation. In other embodiments the 5' UTR can be 5'UTR of an RNA virus whose RNA genome is stable in cells. In other embodiments various nucleotide analogues can be used in the 3' or 5' UTR to impede exonuclease degradation of the mRNA.

To enable synthesis of RNA from a DNA template without the need for gene cloning, a promoter of transcription should be attached to the DNA template upstream of the sequence to be transcribed. When a sequence that functions as a promoter for an RNA polymerase is added to the 5' end of the forward primer, the RNA polymerase promoter becomes incorporated into the PCR product upstream of the open reading frame that is to be transcribed. In one preferred embodiment, the promoter is a T7 polymerase promoter, as described elsewhere herein. Other useful promoters include, but are not limited to, T3 and SP6 RNA polymerase promoters. Consensus nucleotide sequences for T7, T3 and SP6 promoters are known in the art.

In a preferred embodiment, the mRNA has both a cap on the 5' end and a 3' poly(A) tail which determine ribosome binding, initiation of translation and stability mRNA in the cell. On a circular DNA template, for instance, plasmid DNA, RNA polymerase produces a long concatameric product which is not suitable for expression in eukaryotic cells. The transcription of plasmid DNA linearized at the end of the 3' UTR results in normal sized mRNA which is not effective in eukaryotic transfection even if it is polyadenylated after transcription.

On a linear DNA template, phage T7 RNA polymerase can extend the 3' end of the transcript beyond the last base of the template (Schenborn and Mierendorf, Nuc Acids Res., 13:6223-36 (1985); Nacheva and Berzal-Herranz, Eur. J. Biochem., 270:1485-65 (2003)).

The conventional method of integration of polyA/T stretches into a DNA template is molecular cloning. However, polyA/T sequence integrated into plasmid DNA can cause plasmid instability, which is why plasmid DNA templates obtained from bacterial cells are often highly contaminated with deletions and other aberrations. This makes cloning procedures not only laborious and time consuming but often not reliable. That is why a method which allows construction of DNA templates with polyA/T 3' stretch without cloning highly desirable.

The polyA/T segment of the transcriptional DNA template can be produced during PCR by using a reverse primer containing a polyT tail, such as 100 T tail (size can be 50-5000 Ts), or after PCR by any other method, including, but not limited to, DNA ligation or in vitro recombination. Poly(A) tails also provide stability to RNAs and reduce their degradation. Generally, the length of a poly(A) tail positively correlates with the stability of the transcribed RNA. In one embodiment, the poly(A) tail is between 100 and 5000 adenosines.

Poly(A) tails of RNAs can be further extended following in vitro transcription with the use of a poly(A) polymerase, such as *E. coli* polyA polymerase (E-PAP). In one embodiment, increasing the length of a poly(A) tail from 100 nucleotides to between 300 and 400 nucleotides results in about a two-fold increase in the translation efficiency of the RNA. Additionally, the attachment of different chemical groups to the 3' end can increase mRNA stability. Such attachment can contain modified/artificial nucleotides, aptamers and other compounds. For example, ATP analogs can be incorporated into the poly(A) tail using poly(A) polymerase. ATP analogs can further increase the stability of the RNA.

5' caps on also provide stability to RNA molecules. In a preferred embodiment, RNAs produced by the methods disclosed herein include a 5' cap. The 5' cap is provided using techniques known in the art and described herein (Cougot, et al., Trends in Biochem. Sci., 29:436-444 (2001); Stepinski, et al., RNA, 7:1468-95 (2001); Elango, et al., Biochim. Biophys. Res. Commun., 330:958-966 (2005)).

The RNAs produced by the methods disclosed herein can also contain an internal ribosome entry site (IRES) sequence. The IRES sequence may be any viral, chromosomal or artificially designed sequence which initiates cap-independent ribosome binding to mRNA and facilitates the initiation of translation. Any solutes suitable for cell electroporation, which can contain factors facilitating cellular permeability and viability such as sugars, peptides, lipids, proteins, antioxidants, and surfactants can be included.

RNA can be introduced into target cells using any of a number of different methods, for instance, commercially available methods which include, but are not limited to, electroporation (Amaxa Nucleofector-II (Amaxa Biosystems, Cologne, Germany)), (ECM 830 (BTX) (Harvard Instruments, Boston, Mass.) or the Gene Pulser II (BioRad, Denver, Colo.), Multiporator (Eppendort, Hamburg Germany), cationic liposome mediated transfection using lipofection, polymer encapsulation, peptide mediated transfection, or biolistic particle delivery systems such as "gene guns" (see, for example, Nishikawa, et al. Hum Gene Ther., 12(8):861-70 (2001)).

For additional information on making and using TFP T cells, see U.S. Pat. Nos. 10,442,849, 10,358,473, 10,358,474, and 10,208,285, each of which is herein incorporated by reference.

Recombinant Nucleic Acid Encoding a TFP and a TCR Constant Domain

In some embodiments, the CD70 TFP described herein can further comprise a sequence encoding a TCR constant domain, wherein the TCR constant domain is a TCR alpha constant domain, a TCR beta constant domain, a TCR alpha constant domain and a TCR beta constant domain, a TCR gamma constant domain, a TCR delta constant domain, or a TCR gamma constant domain and a TCR delta constant domain. The TCR subunit and the antibody can be operatively linked. The TFP can functionally incorporate into a TCR complex (e.g., an endogenous TCR complex) when expressed in a T cell.

The constant domain can comprise a constant domain of a TCR alpha chain, a TCR beta chain, a TCR gamma chain or a TCR delta chain. The constant domain can comprise a full-length constant domain of a TCR alpha chain, a TCR beta chain, a TCR gamma chain or a TCR delta chain. The constant domain can comprise a fragment (e.g., functional fragment) of the full-length constant domain of a TCR alpha chain, a TCR beta chain, a TCR gamma chain or a TCR delta chain. For example, the constant domain can comprise at least about 5, 10, 15, 20, 25, 30, 35, 40, 45, 50, 55, 60, 65, 70, 75, 80, 85, 90, 95, 100, 150 or more amino acid residues of the constant domain of a TCR alpha chain, a TCR beta chain, a TCR gamma chain or a TCR delta chain. The sequence encoding the TCR constant domain can further encode the transmembrane domain and/or intracellular region of a TCR alpha chain, a TCR beta chain, a TCR gamma chain or a TCR delta chain. The sequence encoding the TCR constant domain can encode a full-length constant region of a TCR alpha chain, a TCR beta chain, a TCR gamma chain or a TCR delta chain. The constant region of a TCR chain can comprise a constant domain, a transmembrane domain, and an intracellular region. The constant region of a TCR chain can also exclude the transmembrane domain and the intracellular region of the TCR alpha chain, a TCR beta chain, a TCR gamma chain or a TCR delta chain.

The TCR alpha chain, a TCR beta chain, a TCR gamma chain or a TCR delta chain described herein can be derived from various species. The TCR chain can be a murine or human TCR chain. For example, the constant domain can comprise a constant domain of a murine or human TCR alpha chain, TCR beta chain, TCR gamma chain or TCR delta chain.

The murine TCR alpha constant domain can comprise positions 2-137 of SEQ ID NO:1267. The murine TCR alpha constant domain can comprise truncations, additions, or substitutions of a sequence of a constant domain described herein. For example, the constant domain can comprise a truncated version of a constant domain described herein having at least about 5, 10, 15, 20, 25, 30, 35, 40, 45, 50, 55, 60, 65, 70, 75, 80, 85, 90, 95, 100, 150 or more amino acid residues of positions 2-137 of SEQ ID NO:1267. For example, the constant domain can comprise a sequence having at least about 5, 10, 15, 20, 25, 30, 35, 40, 45, 50, 55, 60, 65, 70, 75, 80, 85, 90, 95, 100, 150 or more additional amino acid residues of positions 2-137 of SEQ ID NO:1267. For example, the constant domain can comprise a sequence having at least about 5, 10, 15, 20, 25, 30, 35, 40, 45, 50, 55, 60, 65, 70, 75, 80, 85, 90, 95, 100, 150 or more amino acid substitutions of positions 2-137 of SEQ ID NO:1267. The constant domain can comprise a sequence or fragment thereof of positions 2-137 of SEQ ID NO:1267. The constant domain can comprise at least 1, 2, 3, 4, 5, 6, 7, 8, 9, 10 or more modifications, mutations or deletions of the sequence of positions 2-137 of SEQ ID NO:1267. The constant domain can comprise at most 20, 19, 18, 17, 16, 15, 14, 13, 12, 11, 10, 9, 8, 7, 6, 5, 4, 3, 2 or 1 modification, mutations or deletions of the sequence of positions 2-137 of SEQ ID NO:1267. The constant domain can comprise a sequence having a sequence identity of at least about 40%, 45%, 50%, 55%, 60%, 65%, 70%, 75%, 80%, 85%, 90%, 95%, 99% or 100% to the sequence of positions 2-137 of SEQ ID NO:1267.

The murine TCR beta constant domain can comprise positions 2-173 of SEQ ID NO:1268. The murine TCR beta constant domain can comprise truncations, additions, or substitutions of a sequence of a constant domain described herein. For example, the constant domain can comprise a truncated version of a constant domain described herein having at least about 5, 10, 15, 20, 25, 30, 35, 40, 45, 50, 55, 60, 65, 70, 75, 80, 85, 90, 95, 100, 150 or more amino acid residues of positions 2-173 of SEQ ID NO:1268. For example, the constant domain can comprise a sequence having at least about 5, 10, 15, 20, 25, 30, 35, 40, 45, 50, 55, 60, 65, 70, 75, 80, 85, 90, 95, 100, 150 or more additional amino acid residues of positions 2-173 of SEQ ID NO:1268. For example, the constant domain can comprise a sequence having at least about 5, 10, 15, 20, 25, 30, 35, 40, 45, 50, 55, 60, 65, 70, 75, 80, 85, 90, 95, 100, 150 or more amino acid substitutions of positions 2-173 of SEQ ID NO:1268. The constant domain can comprise a sequence or fragment thereof of positions 22-173 of SEQ ID NO:1268. The constant domain can comprise at least 1, 2, 3, 4, 5, 6, 7, 8, 9, 10 or more modifications, mutations or deletions of the sequence of positions 2-173 of SEQ ID NO:1268. The constant domain can comprise at most 20, 19, 18, 17, 16, 15, 14, 13, 12, 11, 10, 9, 8, 7, 6, 5, 4, 3, 2 or 1 modification, mutations or deletions of the sequence of positions 2-173 of SEQ ID NO:1268. The constant domain can comprise a sequence having a sequence identity of at least about 40%, 45%, 50%, 55%, 60%, 65%, 70%, 75%, 80%, 85%, 90%, 95%, 99% or 100% to the sequence of positions 2-173 of SEQ ID NO: 1268.

The TCR gamma constant domain can comprise SEQ ID NO:721, functional fragments thereof, and amino acid sequences thereof having at least one but not more than 20 modifications. In some cases, the sequence encoding the TCR gamma constant domain further encodes a TCR gamma variable domain, thereby encoding a full TCR gamma domain. The full TCR gamma domain can be gamma 9 or gamma 4. The full TCR gamma domain can comprise SEQ ID NO:1269, functional fragments thereof, and amino acid sequences thereof having at least one but not more than 20 modifications.

The TCR delta constant domain can comprise SEQ ID NO:725, functional fragments thereof, or amino acid sequences thereof having at least one but not more than 20 modifications. In some cases, the sequence encoding a TCR delta constant domain further encodes a TCR delta variable domain, thereby encoding a full TCR delta domain. The full TCR delta domain can be delta 2 or delta 1. The full TCR delta constant domain can comprise SEQ ID NO:1270, functional fragments thereof, and amino acid sequences thereof having at least one but not more than 20 modifications.

In some instances, the sequence encoding the TCR constant domain can further encode a second antigen binding domain or ligand binding domain that is operatively linked to the sequence encoding the TCR constant domain.

In some embodiments, a TCR alpha and/or TCR beta constant domain is expressed with a TFP in a cell in which TRAC or TRBC has been inactivated. In some embodiments, a TCR gamma and/or TCR delta constant domain is expressed with a TFP in a cell in which TRAC or TRBC has been inactivated.

Switch Molecule

In some instances, the modified T cells further comprise a nucleic acid encoding an inhibitory molecule that comprises a first polypeptide comprising at least a portion of an inhibitory molecule, associated with a second polypeptide comprising a positive signal from an intracellular signaling domain. In some instances, the inhibitory molecule comprises the first polypeptide comprising at least a portion of PD-1 and the second polypeptide comprising a costimulatory domain and primary signaling domain. In some embodiments, a T cell expressing the TFP as descried herein and a PD-1 switch molecule as descried herein can inhibit tumor growth when expressed in a T cell.

Disclosed herein, in some embodiments, are recombinant nucleic acid molecules comprising a first sequence encoding a TFP as described herein and a second nucleic acid sequence encoding an agent that can enhance the activity of a modified T cell expressing the TFP as described herein. In some embodiments, the second nucleic acid sequence is included in a separate nucleic acid sequence. In some embodiments, the second nucleic acid sequence is included in the same nucleic acid molecule as the recombinant nucleic acid molecules. For example, in one embodiment, the agent that can enhance the activity of a modified T cell can be a PD-1 polypeptide. In these embodiments, the PD-1 polypeptide may be operably linked to the N-terminus of an intracellular domain of a costimulatory polypeptide via the C-terminus of the PD-1 polypeptide. For example, in another embodiment, the agent that can enhance the activity of a modified T cell can be an anti-PD-1 antibody, or antigen binding fragment thereof. In this embodiment, the anti-PD-1 antibody or antigen binding fragment thereof may be operably linked to the N-terminus of an intracellular domain of a costimulatory polypeptide via the C-terminus of the anti-PD-1 antibody, or antigen binding fragment thereof. In some embodiments, the PD-1 polypeptide or anti-PD-1 antibody is linked to the intracellular domain of the costimulatory polypeptide via the transmembrane domain of PD-1. In some embodiments, the costimulatory polypeptide is selected from the group consisting of OX40, CD2, CD27, CD5, ICAM-1, ICOS (CD278), 4-1BB (CD137), GITR, CD28, CD30, CD40, IL-15Ra, IL12R, IL18R, IL21R, BAFFR, HVEM, CD7, LIGHT, NKG2C, SLAMF7, NKp80, CD160, CD226, FcγRI, FcγRII, and FcγRIII. In some embodiments, the costimulatory peptide is CD28.

Disclosed herein, in some embodiments, are recombinant nucleic acid molecules comprising a sequence encoding a TFP as described herein, wherein the recombinant nucleic acid molecules further comprising an agent that can enhance the activity of a modified T cell expressing the TFP as described herein. In another aspect, the cells expressing TFP as described herein can further express another agent, e.g., an agent which enhances the activity of a modified T cell. For example, in one embodiment, the agent can be an agent which inhibits an inhibitory molecule. Inhibitory molecules, e.g., PD-1, can, in some embodiments, decrease the ability of a modified T cell to mount an immune effector response. Examples of inhibitory molecules include PD-1, PD-L1, CTLA4, TIM3, LAG3, VISTA, BTLA, TIGIT, LAIR1, CD160, and 2B4. In one embodiment, the agent which inhibits an inhibitory molecule comprises a first polypeptide, e.g., an inhibitory molecule, associated with a second polypeptide that provides a positive signal to the cell, e.g., an intracellular signaling domain as described herein. In one embodiment, the agent comprises a first polypeptide, e.g., of an inhibitory molecule such as PD-1, LAG3, CTLA4, CD160, BTLA, LAIR1, TIM3, 2B4, and TIGIT, or a fragment of any of these (e.g., at least a portion of an extracellular domain of any of these), and a second polypeptide which is an intracellular signaling domain described herein (e.g., comprising a costimulatory domain (e.g., 4-1BB, CD27 or CD28, e.g., as described herein) and/or a primary signaling domain (e.g., a CD3 zeta signaling domain described herein). In one embodiment, the agent comprises a first polypeptide of PD-1 or a fragment thereof (e.g., at least a portion of an extracellular domain of PD-1), and a second polypeptide of an intracellular signaling domain described herein (e.g., a CD28 signaling domain described herein and/or a CD3 zeta signaling domain described herein). In some embodiments, the recombinant nucleic acid molecules as described herein further comprises a sequence encoding PD-1 or a fragment thereof. In some embodiments, the recombinant nucleic acid molecules as described herein further comprises a sequence encoding the extracellular domain of PD-1. In some embodiments, the recombinant nucleic acid molecules as described herein comprises a sequence encoding the extracellular domain and transmembrane domain of PD-1. In some embodiments, the recombinant nucleic acid molecules as described herein may further comprise a sequence encoding CD28 or a fragment thereof. In some embodiments, the recombinant nucleic acid molecules as described herein comprises a sequence encoding the intracellular domain of CD28. In some embodiments, the recombinant nucleic acid molecules as described herein comprises a sequence encoding a fusion protein comprising the PD-1 extracellular domain and transmembrane domain linked to the CD28 intracellular domain linked to intracellular domain. In some embodiments, the agent comprises the extracellular and transmembrane domain of PD-1 fused to the intracellular signaling domain of CD28. In some embodiments, the agent comprises SEQ ID NO: 1239. PD1 is an inhibitory member of the CD28 family of receptors that also includes CD28, CTLA-4, ICOS, and BTLA. PD-1 is expressed on activated B cells, T cells and myeloid cells (Agata et al., 1996, Int. Immunol 8:765-75). Two ligands for PD1, PD-L1 and PD-L2, have been shown to downregulate T cell activation upon binding to PD1 (Freeman et al., 2000 J. Exp. Med. 192:1027-34; Latchman et al., 2001 Nat. Immunol. 2:261-8; Carter et al., 2002 Eur. J. Immunol. 32:634-43). PD-L1 is abundant in human cancers (Dong et al., 2003 J. Mol. Med. 81:281-7; Blank et al., 2005 Cancer Immunol. Immunother. 54:307-314; Konishi et al., 2004 Clin. Cancer Res. 10:5094). Immune suppression can be reversed by inhibiting the local interaction of PD1 with PD-L1.

In one embodiment, the agent comprises the extracellular domain (ECD) of an inhibitory molecule, e.g., PD-1 can be fused to a transmembrane domain and optionally an intracellular signaling domain such as 41BB and CD3 zeta (also referred to herein as a PD-1 TFP). In one embodiment, the PD-1 TFP, when used in combinations with an anti-TAA TFP described herein, improves the persistence of the T cell. In one embodiment, the TFP is a PD-1 TFP comprising the extracellular domain of PD-1. Alternatively, provided are TFPs containing an antibody or antibody fragment such as a scFv that specifically binds to the Programmed Death-Ligand 1 (PD-L1) or Programmed Death-Ligand 2 (PD-L2).

In one aspect, the present disclosure provides a population of cells wherein at least one cell in the population expresses a TFP having a domain described herein, and a second cell expressing another agent, e.g., an agent which enhances the activity of a modified T cell. For example, in one embodiment, the agent can be an agent which inhibits an inhibitory molecule. Inhibitory molecules, e.g., can, in some embodiments, decrease the ability of a modified T cell to mount an immune effector response. Examples of inhibitory molecules include PD-1, PD-L1, PD-L2, CTLA4, TIM3, LAG3, VISTA, BTLA, TIGIT, LAIR1, CD160, and 2B4. In one embodiment, the agent that inhibits an inhibitory molecule comprises a first polypeptide, e.g., an inhibitory molecule, associated with a second polypeptide that provides a positive signal to the cell, e.g., an intracellular signaling domain described herein.

Recombinant Nucleic Acid Encoding a Switch Molecule

Disclosed herein are recombinant nucleic acid molecules comprising a first nucleic acid sequence encoding a T cell receptor (TCR) fusion protein (TFP) described herein and a second nucleic acid sequence encoding a switch molecule as described herein. In some embodiments, recombinant nucleic acid molecules comprise a first nucleic acid sequence encoding a T cell receptor (TCR) fusion protein (TFP) and a second nucleic acid sequence encoding an inhibitory molecule that comprises a first polypeptide comprising at least a portion of an inhibitory molecule, associated with a second polypeptide comprising a positive signal from an intracellular signaling domain. In some embodiments, recombinant nucleic acid molecules comprise a first nucleic acid sequence encoding a T cell receptor (TCR) fusion protein (TFP) and a second nucleic acid sequence encoding a inhibitory molecule comprising the first polypeptide comprising at least a portion of PD-1 and the second polypeptide comprising a costimulatory domain and primary signaling domain. In some embodiments, a T cell expressing the TFP as descried herein and a PD-1 switch molecule as descried herein can inhibit tumor growth when expressed in a T cell.

IL-15 and IL-15 Receptor Alpha Polypeptides

In some aspects, the TFP-expressing cells described herein can further express another agent, for example, an agent that can enhance longevity or activity of TFP-expressing cells described herein. In some embodiments, the agent is a cytokine such as a pleiotropic cytokine that plays important roles in maintenance and homeostatic expansion of immune cells. In some embodiments, local secretion of a pleiotropic cytokine in tumor microenvironment (TME) can contribute to enhanced anti-tumor immunity. In some embodiments, the agent activates a cytokine signaling. In some embodiments the agent activates interleukin-15 (IL-15) signaling. In some embodiments the agent comprises interleukin-15 (IL-15) and/or interleukin-15 receptor (IL-15R). In some embodiments, the IL-15R is an IL-15R alpha (IL-15Rα) subunit.

The present disclosure encompasses recombinant nucleic acid molecules encoding an interleukin-15 (IL-15) polypeptide or a fragment thereof. In some embodiments, the IL-15 polypeptide or a fragment thereof comprises 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, or more consecutive amino acid residues of IL-15. In some embodiments, the IL-15 polypeptide or a fragment thereof comprises a sequence having at least about 50%, 55%, 60%, 65%, 70%, 75%, 80%, 85%, 90%, 95%, 98%, 99% or more sequence identity to a sequence encoding IL-15. In some embodiments, the IL-15 polypeptide or a fragment thereof comprises a sequence encoding IL-15 having a truncation of at least 1, 2, 3, 4, 5, 6, 7, 8, 9, 10, 11, 12, 13, 14, 15, 16, 17, 18, 19, 20, 21, 22, 23, 24, 25 or more amino acids at the N- or C-terminus or at both the N- and C-terminus.

In some embodiments, the IL-15 polypeptide or a fragment thereof may comprise an IL-15 signal peptide. In some embodiments, the IL-15 polypeptide or a fragment thereof may comprise amino acids 1-29 of IL-15. In some embodiments, the IL-15 polypeptide or a fragment thereof may comprise amino acids 1-29 of SEQ ID NO: 1245. In some embodiments, the IL-15 polypeptide or a fragment thereof may comprise a sequence of SEQ ID NO: 1246. In some embodiments, the IL-15 polypeptide or a fragment thereof may comprise amino acids 30-162 of IL-15. In some embodiments, the IL-15 polypeptide or a fragment thereof may comprise amino acids 30-162 of SEQ ID NO: 1245. In some embodiments, the IL-15 polypeptide or a fragment thereof may comprise any one of the sequence listed in Table 11 or a fragment thereof. In some embodiments, the IL-15 polypeptide or a fragment thereof may comprise a sequence of SEQ ID NO: 1242. In some embodiments, the IL-15 polypeptide or a fragment thereof may comprise amino acids 1-162 of SEQ ID NO: 1245. In some embodiments, the IL-15 polypeptide or a fragment thereof may comprise a sequence of SEQ ID NO: 1246 and a sequence of SEQ ID NO: 1242. In some embodiments, IL-15 polypeptide is secreted when expressed in a cell, such as a T cell.

The present disclosure further encompasses recombinant nucleic acid molecules encoding an interleukin-15 receptor (IL-15R) subunit polypeptide or a fragment thereof. For example, the IL-15R subunit may be IL-15 receptor alpha chain ("IL-15Rα" or CD215), IL-2 receptor beta chain ("IL-2Rβ" or CD122) and IL-2 receptor gamma/the common gamma chain ("IL-2Rγ/γc" or CD132). In some embodiments, the IL-15R subunit is an IL-15Rα or a fragment thereof. In some embodiments, the IL-15Rα polypeptide or a fragment thereof comprises 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, or more consecutive amino acid residues of IL-15Rα. In some embodiments, the IL-15Rα polypeptide or a fragment thereof comprises a sequence having at least about 50%, 55%, 60%, 65%, 70%, 75%, 80%, 85%, 90%, 95%, 98%, 99% or more sequence identity to a sequence encoding IL-15Rα. In some embodiments, the IL-15Rα polypeptide or a fragment thereof comprises a sequence encoding IL-15Rα having a truncation of at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, or more amino acids at the N- or C-terminus or at both the N- and C-terminus.

In some embodiments, the IL-15Rα polypeptide or a fragment thereof may comprise IL-15Rα signal peptide. In some embodiments, the IL-15Rα polypeptide or a fragment thereof may comprise amino acids 1-30 of IL-15Rα. In some embodiments, the IL-15Rα polypeptide or a fragment thereof may comprise amino acids 1-30 of SEQ ID NO: 1247. In some embodiments, the IL-15Rα polypeptide or a fragment thereof does not comprise IL-15Rα signal peptide. In some embodiments, the IL-15Rα polypeptide or a fragment thereof does not comprise amino acids 1-30 of IL-15Rα. In some embodiments, the IL-15Rα polypeptide or a fragment thereof does not comprise amino acids 1-30 of SEQ ID NO: 1247.

In some embodiments, the IL-15Rα polypeptide or a fragment thereof may comprise IL-15Rα Sushi domain. In some embodiments, the IL-15Rα polypeptide or a fragment thereof may comprise amino acids 31-95 of IL-15Rα. In some embodiments, the IL-15Rα polypeptide or a fragment thereof may comprise amino acids 31-95 of SEQ ID NO: 1247. In some embodiments, the IL-15Rα polypeptide or a fragment thereof may comprise a sequence of SEQ ID NO: 1250.

In some embodiments, the IL-15Rα polypeptide or a fragment thereof may comprise an intracellular domain of IL-15Rα. In some embodiments, the IL-15Rα polypeptide or a fragment thereof may comprise amino acids 229-267 of IL-15Rα. In some embodiments, the IL-15Rα polypeptide or a fragment thereof may comprise amino acids 229-267 of a sequence of SEQ ID NO: 1247. In some embodiments, the IL-15Rα polypeptide or a fragment thereof may comprise a sequence of SEQ ID NO: 1248.

In some embodiments, the IL-15Rα polypeptide or a fragment thereof may comprise IL-15Rα Sushi domain, transmembrane domain, and intracellular domain. In some embodiments, the IL-15Rα polypeptide or a fragment thereof may comprise amino acids 31-267 of IL-15Rα. In some embodiments, the IL-15Rα polypeptide or a fragment thereof may comprise amino acids 31-267 of SEQ ID NO: 1247. In some embodiments, the IL-15Rα polypeptide or a fragment thereof may comprise a sequence of SEQ ID NO: 1250. In some embodiments, the IL-15Rα polypeptide or a fragment thereof may comprise a sequence of SEQ ID NO: 1251. In some embodiments, the IL-15Rα polypeptide or a fragment thereof may comprise amino acids 96-267 of SEQ ID NO: 1247. In some embodiments, the IL-15Rα polypeptide or a fragment thereof may comprise a sequence of SEQ ID NO: 1250 and a sequence of SEQ ID NO: 1251.

In some embodiments, the IL-15Rα polypeptide or a fragment thereof may be a soluble IL-15Rα (sIL-15Rα). In some embodiments, the IL-15Rα polypeptide or a fragment thereof may comprise amino acids 21-205 of IL-15Rα. In some embodiments, the IL-15Rα polypeptide or a fragment thereof may comprise amino acids 21-205 of a sequence of SEQ ID NO: 1247. In some embodiments, the IL-15Rα polypeptide or a fragment thereof may comprise a sequence of SEQ ID NO: 1249.

The present disclosure encompasses recombinant nucleic acid molecules encoding a fusion protein comprising an IL-15 polypeptide linked to an IL-15R subunit. In some embodiments, IL-15 and IL-15R subunit are operatively linked by a linker. In some embodiments, the IL-15R subunit is IL-15R alpha (IL-15Rα). For example, IL-15 polypeptide may be linked to N-terminus of IL-15Rα subunit. For example, IL-15 polypeptide may be linked to C-terminus of IL-15Rα subunit. In some embodiments, IL-15 and IL-15Rα are operatively linked by a linker. In some embodiments, the linker is not a cleavable linker. For example, the linker may comprise a sequence comprising $(G_4S)_n$, wherein G is glycine, S is serine, and n is an integer from 1 to 10. In some embodiments, n is an integer from 1 to 4. In some embodiments, n is 3. In some embodiments, the linker comprises a sequence of SEQ ID NO: 1243.

In some embodiments, the fusion protein may comprise amino acids 30-162 of IL-15. In some embodiments, the fusion protein may comprise amino acids 30-162 of a sequence of SEQ ID NO: 1245. In some embodiments, the fusion protein may comprise any one of the sequence listed in Table 11 or a fragment thereof. In some embodiments, the fusion protein may comprise a sequence of SEQ ID NO: 1242. In some embodiments, the fusion protein does not comprise IL-15 signal peptide. In some embodiments, the fusion protein does not comprise amino acids 1-29 of IL-15. In some embodiments, the fusion protein does not comprise amino acids 1-29 of a sequence of SEQ ID NO: 1245. In some embodiments, the fusion protein does not comprise a sequence of SEQ ID NO: 1246.

In some embodiments, the fusion protein may comprise a Sushi domain. In some embodiments, the fusion protein may comprise amino acids 31-95 of IL-15Rα. In some embodiments, the fusion protein may comprise amino acids 31-95 of a sequence of SEQ ID NO: 1247. In some embodiments, the fusion protein may comprise a sequence of SEQ ID NO: 1250.

In some embodiments, the fusion protein may comprise the intracellular domain of IL-15Rα. In some embodiments, the fusion protein may comprise amino acids 229-267 of IL-15Rα. In some embodiments, the fusion protein may comprise amino acids 229-267 of a sequence of SEQ ID NO: 1247. In some embodiments, the fusion protein may comprise a sequence of SEQ ID NO: 1248.

In some embodiments, the fusion protein may comprise a soluble IL-15Rα (sIL-15Rα). In some embodiments, the fusion protein may comprise amino acids 21-205 of IL-15Rα. In some embodiments, the fusion protein may comprise amino acids 21-205 of a sequence of SEQ ID NO: 1247. In some embodiments, the fusion protein may comprise a sequence of SEQ ID NO: 1249.

In some embodiments, the fusion protein may comprise the transmembrane domain and the intracellular domain of IL-15Rα. In some embodiments, the fusion protein may comprise amino acids 96-267 of IL-15Rα. In some embodiments, the fusion protein may comprise amino acids 96-267 of a sequence of SEQ ID NO: 1247. In some embodiments, the fusion protein may comprise a sequence of SEQ ID NO: 1251.

In some embodiments, the fusion protein may comprise the Sushi domain, the transmembrane domain, and the intracellular domain of IL-15Rα. In some embodiments, the fusion protein may comprise amino acids 31-267 of IL-15Rα. In some embodiments, the fusion protein may comprise amino acids 31-267 of a sequence of SEQ ID NO: 1247. In some embodiments, the fusion protein may comprise a sequence of SEQ ID NO: 1250 and a sequence of SEQ ID NO: 1251.

In some embodiments, the fusion protein further comprises an epitope tag. An epitope tag as described herein can be a peptide epitope tag or a protein epitope tag. Examples of a peptide epitope tag includes, but are not limited to, 6×His (also known as His-tag or hexahistidine tag), FLAG (e.g., 3×FLAG), HA, Myc, and V5. Examples of a protein epitope tag include, but are not limited to, green fluorescent protein (GFP), glutathione-S-transferase (GST), β-galactosidase (β-GAL), Luciferase, Maltose Binding Protein (MBP), Red Fluorescence Protein (RFP), and Vesicular Stomatitis Virus Glycoprotein (VSV-G). In some embodiments, the fusion protein further comprises a FLAG tag. In some embodiments, the fusion protein further comprises a 3×FLAG tag. In some embodiments, the fusion protein further comprises a sequence of SEQ ID NO: 1255.

```
Flag x3
                                        (SEQ ID NO: 1255)
DYKDDDDKDYKDDDDKDYKDDDDK
```

In some embodiments, the fusion protein is expressed on cell surface when expressed in a T cell. In some embodiments, the fusion protein is secreted when expressed in a T cell.

In some aspects, cells expressing TFPs, an IL-15 polypeptide or a fragment thereof, an IL-15Rα polypeptide or a fragment thereof, and/or a fusion protein comprising an IL-15 polypeptide and an IL-15Rα polypeptide described herein can yet further express another agent that can enhance the activity of a modified T cell expressing TFPs. For example, in one embodiment, the agent that can enhance the activity of a modified T cell can be a PD-1 polypeptide. In these embodiments, the PD-1 polypeptide may be operably linked to the N-terminus of an intracellular domain of a costimulatory polypeptide via the C-terminus of the PD-1 polypeptide. For example, in another embodiment, the agent that can enhance the activity of a modified T cell expressing TFPs can be an anti-PD-1 antibody, or antigen binding fragment thereof. In this embodiment, the anti-PD-1 antibody or antigen binding fragment thereof may be operably linked to the N-terminus of an intracellular domain of a costimulatory polypeptide via the C-terminus of the anti-PD-1 antibody, or antigen binding fragment thereof. In some embodiments, the PD-1 polypeptide or anti-PD-1 antibody is linked to the intracellular domain of the costimulatory polypeptide via the transmembrane domain of PD-1. In some embodiments, the costimulatory polypeptide is selected from the group consisting of OX40, CD2, CD27, CDS, ICAM-1, ICOS (CD278), 4-1BB (CD137), GITR, CD28, CD30, CD40, BAFFR, HVEM, CD7, LIGHT, NKG2C, SLAMF7, NKp80, CD160, CD226, FcγRI, FcγRII, and FcγRIII. In some embodiments, the costimulatory polypeptide is CD28.

In some aspects, the agent that can enhance the activity of a modified T cell expressing TFPs can be linked to an IL-15Rα polypeptide or a fragment thereof. For example, the agent can be an agent that can inhibit an inhibitory molecule that can decrease the ability of a T cell expressing a TFP to mount an immune effector response. In some embodiments, the agent which inhibits an inhibitory molecule comprises a first polypeptide, e.g., an inhibitory molecule, associated with a second polypeptide that provides a positive signal to the cell, e.g., an intracellular signaling domain described herein. In one embodiment, the agent may comprise a first polypeptide, e.g., of an inhibitory molecule such as PD-1, LAG3, CTLA4, CD160, BTLA, LAIR1, TIM3, 2B4, and TIGIT, or a fragment of any of these (e.g., at least a portion of an extracellular domain of any of these), and a second polypeptide which is an intracellular signaling domain described herein (e.g., comprising a costimulatory domain (e.g., 4-1BB, CD27, or CD28, as described herein)) and/or a primary signaling domain (e.g., IL-15Rα described herein). In some embodiments, the agent may be PD-1 or a fragment thereof. For example, the agent may comprise the extracellular domain of PD-1. In some embodiments, the agent may comprise the extracellular domain and transmembrane domain of PD-1. In some embodiments, the agent may further comprise CD28 or a fragment thereof. In some embodiments, the agent may comprise the intracellular domain of CD28. In some embodiments, the agent may comprise a fusion protein comprising the PD-1 extracellular domain and transmembrane domain linked to the CD28 intracellular domain linked to IL-15Rα. In some embodiments, the CD28 intracellular domain is linked to the intracellular domain of IL-15Rα.

In some embodiments, the PD-1 or a fragment thereof may comprise any one of the sequence listed in Table 10 or a fragment thereof. In some embodiments, the PD-1 or a fragment thereof may comprise a sequence of SEQ ID NO: 1256. In some embodiments, the PD-1 or a fragment thereof may comprise a sequence of SEQ ID NO: 1257. In some embodiments, the PD-1 or a fragment thereof may comprise a sequence of SEQ ID NO: 1258. In some embodiments, the PD-1 or a fragment thereof may comprise a sequence of SEQ ID NO: 1259. In some embodiments, the transmembrane domain of PD-1 may comprise a sequence of SEQ ID NO: 1239. In some embodiments, the intracellular domain of CD28 may comprise a sequence of SEQ ID NO: 1260. In some embodiments, the intracellular domain of IL-15Rα comprises amino acids 229-267 of IL-15Rα. In some embodiments, the intracellular domain of IL-15Rα comprises amino acids 229-267 of a sequence of SEQ ID NO: 1247. In some embodiments, the fusion protein comprises a sequence of SEQ ID NO: 1248.

In some aspects, the agent that can enhance the activity of a modified T cell expressing TFPs can be linked to a fusion protein comprising an IL-15 polypeptide and an IL-15Rα polypeptide. In some embodiments, the agent may be PD-1 or a fragment thereof. For example, the agent may comprise the extracellular domain of PD-1. In some embodiments, the agent may comprise the extracellular domain and transmembrane domain of PD-1. In some embodiments, the agent may further comprise CD28 or a fragment thereof. In some embodiments, the agent may comprise the intracellular domain of CD28. In some embodiments, the agent may comprise a fusion protein comprising the PD-1 extracellular domain and transmembrane domain linked to the CD28 intracellular domain linked to the fusion protein comprising an IL-15 polypeptide and an IL-15Rα polypeptide. In some embodiments, the CD28 intracellular domain is linked to the intracellular domain of IL-15Rα. In some embodiments, the intracellular domain of IL-15Rα is linked to the IL-15 polypeptide by a linker described herein. In some embodiments, the linker comprises a cleavage site. The cleavage site can be a self-cleaving peptide such as a T2A, P2A, E2A or F2A cleavage site. In some embodiments, the cleavage site can comprise a sequence of SEQ ID NO: 1261 (P2A: GSGATNFSLLKQAGDVEENPG).

In some embodiments, the fusion protein may comprise a PD-1 or a fragment thereof comprising any one of the sequence listed in Table 10 or a fragment thereof. In some embodiments, the fusion protein may comprise a PD-1 or a fragment thereof comprising a sequence of SEQ ID NO: 1256. In some embodiments, the fusion protein may comprise a PD-1 or a fragment thereof comprising a sequence of SEQ ID NO: 1257. In some embodiments, the fusion protein may comprise a PD-1 or a fragment thereof comprising a sequence of SEQ ID NO: 1258. In some embodiments, the fusion protein may comprise a PD-1 or a fragment thereof comprising a sequence of SEQ ID NO: 1259. In some embodiments, the fusion protein may comprise a PD-1 or a fragment thereof comprising a transmembrane domain of PD-1 comprising a sequence of SEQ ID NO: 1239. In some embodiments, the fusion protein may comprise a CD28 or a fragment comprising the intracellular domain of CD28 comprising a sequence of SEQ ID NO: 1260. In some embodiments, the intracellular domain of IL-15Rα comprises amino acids 229-267 of IL-15Rα. In some embodiments, the intracellular domain of IL-15Rα comprises amino acids 229-267 of a sequence of SEQ ID NO: 1247. In some embodiments, the fusion protein comprises a sequence of SEQ ID NO: 1248. In some embodiments, the IL-15 polypeptide comprises IL-15 signal peptide. In some embodiments, the IL-15 polypeptide comprises amino acids 1-29 of IL-15. In some embodiments, the IL-15 polypeptide comprises amino acids 1-29 of a sequence of SEQ ID NO: 1245. In some embodiments, the IL-15 polypeptide comprises a sequence of SEQ ID NO: 1246. In some embodiments, the IL-15 polypeptide comprises amino acids 30-162 of IL-15. In some embodiments, the IL-15 polypeptide comprises amino acids 30-162 of a sequence of SEQ ID NO: 1245. In some embodiments, the IL-15 polypeptide comprises a sequence of SEQ ID NO: 1242.

Disclosed herein, in some embodiments, are polypeptides encoded by any of recombinant nucleic acid molecules described herein.

Recombinant Nucleic Acid Encoding IL-15 and/or IL-15Rα

Disclosed herein are recombinant nucleic acid molecules comprising a first nucleic acid sequence encoding a T cell receptor (TCR) fusion protein (TFP) described herein and a second nucleic acid sequence encoding an Interleukin-15 (IL-15) polypeptide or a fragment thereof. Disclosed herein are recombinant nucleic acid molecules comprising a first nucleic acid sequence encoding a T cell receptor (TCR) fusion protein (TFP) and a second nucleic acid sequence encoding an Interleukin-15 receptor alpha (IL-15Rα) polypeptide or a fragment thereof. Also disclosed herein are recombinant nucleic acid molecules a first nucleic acid sequence encoding a T cell receptor (TCR) fusion protein (TFP) and a second nucleic acid sequence encoding a fusion protein comprising an IL-15 polypeptide or a fragment thereof linked to an IL-15Rα polypeptide or a fragment thereof. Further disclosed herein are recombinant nucleic acid molecules a first nucleic acid sequence encoding a T cell receptor (TCR) fusion protein (TFP) and a second nucleic acid sequence encoding a fusion protein comprising a fusion protein comprising an IL-15Rα polypeptide or a fragment thereof linked to PD-1 or a fragment thereof and/or CD28 or a fragment thereof.

Disclosed herein are recombinant nucleic acid molecules comprising a first nucleic acid sequence encoding a TFP described herein and a second nucleic acid sequence encoding an IL-15 polypeptide or a fragment thereof. Any recombinant nucleic acid molecules comprising a nucleic acid sequence encoding a TFP described herein may further comprise a second nucleic acid sequence encoding an IL-15 polypeptide or a fragment thereof. Further disclosed herein are recombinant nucleic acid molecules comprising a first nucleic acid sequence encoding a TFP described herein and a second nucleic acid sequence encoding an IL-15Rα polypeptide or a fragment thereof. Any recombinant nucleic acid molecules comprising a nucleic acid sequence encoding a TFP described herein may further comprise a second nucleic acid sequence encoding an IL-15Rα polypeptide or a fragment thereof.

Disclosed herein, in some embodiments, are recombinant nucleic acid molecules comprising a first nucleic acid sequence encoding a TFP described herein and a second nucleic acid sequence encoding an IL-15 polypeptide or a fragment thereof, wherein the first nucleic acid sequence and the second nucleic acid sequence are included in two separate nucleic acid molecules. Disclosed herein, in some embodiments, are recombinant nucleic acid molecules comprising a first nucleic acid sequence encoding a TFP described herein and a second nucleic acid sequence encoding an IL-15 polypeptide or a fragment thereof, wherein the first nucleic acid sequence and the second nucleic acid sequence are included in a single nucleic acid molecule. In some embodiments, the first nucleic acid sequence and the second nucleic acid sequence are operatively linked by a first linker. Further disclosed herein, in some embodiments, are recombinant nucleic acid molecules comprising a first nucleic acid sequence encoding a TFP described herein and a second nucleic acid sequence encoding an IL-15Rα polypeptide or a fragment thereof, wherein the first nucleic acid sequence and the second nucleic acid sequence are included in two separate nucleic acid molecules. Further disclosed herein, in some embodiments, are recombinant nucleic acid molecules comprising a first nucleic acid sequence encoding a TFP described herein and a second nucleic acid sequence encoding an IL-15Rα polypeptide or a fragment thereof, wherein the first nucleic acid sequence and the second nucleic acid sequence are included in a single nucleic acid molecule. In some embodiments, the first nucleic acid sequence and the second nucleic acid sequence are operatively linked by a first linker. For example, the first linker may be a cleavable linker. In some embodiments, the first linker may comprise a protease cleavage site. The cleavage site can be a self-cleaving peptide, for example, a 2A cleavage site such as a T2A, P2A, E2A or F2A cleavage site. In some embodiments, the protease cleavage site is a T2A cleavage site. The cleavage site can comprise a sequence of SEQ ID NO: 1238, when expressed. In some embodiments, the first linker comprises a sequence of SEQ ID NO: 1238, when expressed.

In some embodiments, the nucleic acid sequence encoding the IL-15 polypeptide, or a fragment thereof may comprise a sequence encoding IL-15 signal peptide. In some embodiments, IL-15 signal peptide comprises amino acids 1-29 of SEQ ID NO: 1245, when expressed. In some embodiments, IL-15 signal peptide comprises a sequence of SEQ ID NO: 1246, when expressed. In some embodiments, the nucleic acid sequence encoding the IL-15 polypeptide, or a fragment thereof may comprise a sequence encoding amino acids 30-162 of SEQ ID NO: 1245. In some embodiments, the nucleic acid sequence encoding the IL-15 polypeptide, or a fragment thereof may comprise a sequence encoding any one of the sequence listed in Table 11 or a fragment thereof. In some embodiments, the nucleic acid sequence encoding the IL-15 polypeptide, or a fragment thereof may comprise a sequence encoding a sequence of SEQ ID NO: 1242. In some embodiments, the nucleic acid sequence encoding the IL-15 polypeptide, or a fragment thereof may comprise a sequence encoding amino acids 1-162 of SEQ ID NO: 1245. In some embodiments, the nucleic acid sequence encoding the IL-15 polypeptide, or a fragment thereof may comprise a sequence encoding a sequence of SEQ ID NO: 1246 and a sequence of SEQ ID NO: 1242. In some embodiments, the IL-15 polypeptide or a fragment thereof is secreted when expressed in a T cell. In some embodiments, the IL-15 polypeptide comprises a sequence of SEQ ID NO: 1242, when expressed.

Disclosed herein, in some embodiments, are recombinant nucleic acid molecules comprising a first nucleic acid sequence encoding a TFP described herein and a second nucleic acid sequence encoding an IL-15 polypeptide or a fragment thereof and an IL-15R subunit or a fragment thereof, wherein the first nucleic acid sequence and the second nucleic acid sequence are included in two separate nucleic acid molecules. Disclosed herein, in some embodiments, are recombinant nucleic acid molecules comprising a first nucleic acid sequence encoding a TFP described herein and a second nucleic acid sequence encoding an IL-15 polypeptide or a fragment thereof and an IL-15R subunit or a fragment thereof, wherein the first nucleic acid sequence and the second nucleic acid sequence are included in a single nucleic acid molecule. In some embodiments, the first nucleic acid sequence and the second nucleic acid sequence are operatively linked by a first linker described herein. An IL-15R subunit may be an IL-15R alpha (IL-15Rα), an IL-2R beta (IL-2β), or an IL-2R gamma/the common gamma chain (IL-2Rγ/γc). In some embodiments, the IL-15R subunit is IL-15R alpha (IL-15Rα). In some embodiments, IL-15 and IL-15R subunit are operatively linked by a second linker. In some embodiments, IL-15 and IL-15Rα are operatively linked by a second linker. In some embodiments, the second linker is not a cleavable linker. For example, the second linker may comprise a sequence comprising $(G_4S)_n$, wherein G is glycine, S is serine, and n is an integer from 1 to 10. In some embodiments, n is an integer from 1 to 4. In some embodiments, n is 3. In some embodiments, the second linker comprises a sequence of SEQ ID NO: 1243.

In some embodiments, the nucleic acid sequence encoding the IL-15Rα polypeptide or a fragment thereof may comprise a sequence encoding the intracellular domain of IL-15Rα. In some embodiments, the nucleic acid sequence encoding the IL-15Rα polypeptide or a fragment thereof may comprise a sequence encoding amino acids 229-267 of IL-15Rα. In some embodiments, the nucleic acid sequence encoding the IL-15Rα polypeptide or a fragment thereof may comprise a sequence encoding amino acids 229-267 of SEQ ID NO: 1247. In some embodiments, the nucleic acid sequence encoding the IL-15Rα polypeptide or a fragment thereof may comprise a sequence encoding a sequence of SEQ ID NO: 1248.

In some embodiments, the nucleic acid sequence encoding the IL-15Rα polypeptide or a fragment thereof may comprise a sequence encoding IL-15Rα Sushi domain. In some embodiments, the nucleic acid sequence encoding the IL-15Rα polypeptide or a fragment thereof may comprise a sequence encoding amino acids 31-95 of IL-15Rα. In some embodiments, the nucleic acid sequence encoding the IL-15Rα polypeptide or a fragment thereof may comprise a sequence encoding amino acids 31-95 of SEQ ID NO: 1247. In some embodiments, the nucleic acid sequence encoding the IL-15Rα polypeptide or a fragment thereof may comprise a sequence encoding a sequence of SEQ ID NO: 1250.

In some embodiments, the nucleic acid sequence encoding the IL-15Rα polypeptide or a fragment thereof may comprise a sequence encoding the transmembrane domain and the intracellular domain of IL-15Rα. In some embodiments, the nucleic acid sequence encoding the IL-15Rα polypeptide or a fragment thereof may comprise a sequence encoding amino acids 96-267 of IL-15Rα. In some embodiments, the nucleic acid sequence encoding the IL-15Rα polypeptide or a fragment thereof may comprise a sequence encoding amino acids 96-267 of SEQ ID NO: 1247. In some embodiments, the nucleic acid sequence encoding the IL-15Rα polypeptide or a fragment thereof may comprise a sequence encoding a sequence of SEQ ID NO: 1251.

In some embodiments, the nucleic acid sequence encoding the IL-15Rα polypeptide or a fragment thereof may comprise a sequence encoding the Sushi domain, the transmembrane domain, and the intracellular domain of IL-15Rα. In some embodiments, the nucleic acid sequence encoding the IL-15Rα polypeptide or a fragment thereof may comprise a sequence encoding amino acids 31- 267 of IL-15Rα. In some embodiments, the nucleic acid sequence encoding the IL-15Rα polypeptide or a fragment thereof may comprise a sequence encoding amino acids 31-267 of SEQ ID NO: 1247. In some embodiments, the nucleic acid sequence encoding the IL-15Rα polypeptide or a fragment thereof may comprise a sequence encoding a sequence of SEQ ID NO: 1250 and a sequence of SEQ ID NO: 1251.

In some embodiments, the nucleic acid sequence encoding the IL-15Rα polypeptide or a fragment thereof may comprise a sequence encoding a soluble IL-15Rα (sIL-15Rα). In some embodiments, the nucleic acid sequence encoding the IL-15Rα polypeptide or a fragment thereof may comprise a sequence encoding amino acids 21-205 of IL-15Rα. In some embodiments, the nucleic acid sequence encoding the IL-15Rα polypeptide or a fragment thereof may comprise a sequence encoding amino acids 21-205 of SEQ ID NO: 1247. In some embodiments, the nucleic acid sequence encoding the IL-15Rα polypeptide or a fragment thereof may comprise a sequence encoding a sequence of SEQ ID NO: 1249.

Disclosed herein, in some embodiments, are recombinant nucleic acid molecules comprising a first nucleic acid sequence encoding a TFP described herein and a second nucleic acid sequence encoding a fusion protein comprising an IL-15 polypeptide linked to an IL-15Rα subunit, wherein the first nucleic acid sequence and the second nucleic acid sequence are included in two separate nucleic acid molecules. Disclosed herein, in some embodiments, are recombinant nucleic acid molecules comprising a first nucleic acid sequence encoding a TFP described herein and a second nucleic acid sequence encoding a fusion protein comprising an IL-15 polypeptide linked to an IL-15Rα subunit, wherein the first nucleic acid sequence and the second nucleic acid sequence are included in a single nucleic acid molecule. In some embodiments, the first nucleic acid sequence and the second nucleic acid sequence are operatively linked by a first linker described herein. For example, IL-15 polypeptide may be linked to N-terminus of IL-15Rα subunit. For example, IL-15 polypeptide may be linked to C-terminus of IL-15Rα subunit.

In some embodiments, the nucleic acid sequence encoding the fusion protein may comprise a sequence encoding amino acids 1-29 of IL-15. In some embodiments, the nucleic acid sequence encoding the fusion protein may comprise a sequence encoding amino acids 1-29 of SEQ ID NO: 1245. In some embodiments, the nucleic acid sequence encoding the fusion protein may comprise a sequence encoding a sequence of SEQ ID NO: 1246. In some embodiments, the nucleic acid sequence encoding the fusion protein may comprise a sequence encoding amino acids 30-162 of IL-15. In some embodiments, the nucleic acid sequence encoding the fusion protein may comprise a sequence encoding amino acids 30-162 of SEQ ID NO: 1245. In some embodiments, the nucleic acid sequence encoding the fusion protein may comprise a sequence encoding any one of the sequence listed in Table 11 or a fragment thereof. In some embodiments, the nucleic acid sequence encoding the fusion protein may comprise a sequence encoding a sequence of SEQ ID NO: 1242. In some embodiments, the nucleic acid sequence encoding the fusion protein may comprise a sequence encoding amino acids 1-162 of IL-15. In some embodiments, the nucleic acid sequence encoding the fusion protein may comprise a sequence encoding amino acids 1-162 of SEQ ID NO: 1245. In some embodiments, the nucleic acid sequence encoding the fusion protein may comprise a sequence encoding a sequence of SEQ ID NO: 1246 and a sequence encoding a sequence of SEQ ID NO: 1242.

In some embodiments, the nucleic acid sequence encoding the fusion protein may comprise a sequence encoding the intracellular domain of IL-15Rα. In some embodiments, the nucleic acid sequence encoding the fusion protein may comprise a sequence encoding amino acids 229-267 of IL-15Rα. In some embodiments, the nucleic acid sequence encoding the fusion protein may comprise a sequence encoding amino acids 229-267 of SEQ ID NO: 1247. In some embodiments, the nucleic acid sequence encoding the fusion protein may comprise a sequence encoding a sequence of SEQ ID NO: 1248.

In some embodiments, the nucleic acid sequence encoding the fusion protein may further comprise a sequence encoding IL-15Rα Sushi domain. In some embodiments, the nucleic acid sequence encoding the fusion protein may comprise a sequence encoding amino acids 31-95 of IL-15Rα. In some embodiments, the nucleic acid sequence encoding the fusion protein may comprise a sequence encoding amino acids 31-95 of SEQ ID NO: 1247. In some embodiments, the nucleic acid sequence encoding the fusion protein may comprise a sequence encoding a sequence of SEQ ID NO: 1250.

In some embodiments, the nucleic acid sequence encoding the fusion protein may comprise a sequence encoding the transmembrane domain and the intracellular domain of IL-15Rα. In some embodiments, the nucleic acid sequence encoding the fusion protein may comprise a sequence encoding amino acids 96-267 of IL-15Rα. In some embodiments, the nucleic acid sequence encoding the fusion protein may comprise a sequence encoding amino acids 96-267 of SEQ ID NO: 1247. In some embodiments, the nucleic acid sequence encoding the fusion protein may comprise a sequence encoding a sequence of SEQ ID NO: 1251.

In some embodiments, the nucleic acid sequence encoding the fusion protein may comprise a sequence encoding the Sushi domain, the transmembrane domain, and the intracellular domain of IL-15Rα. In some embodiments, the nucleic acid sequence encoding the fusion protein may comprise a sequence encoding amino acids 31-267 of IL-15Rα. In some embodiments, the nucleic acid sequence encoding the fusion protein may comprise a sequence encoding amino acids 31-267 of SEQ ID NO: 1247. In some embodiments, the nucleic acid sequence encoding the fusion protein may comprise a sequence encoding a sequence of SEQ ID NO: 1250 and a sequence of SEQ ID NO: 1251.

In some embodiments, the nucleic acid sequence encoding the fusion protein may comprise a sequence encoding a soluble IL-15Rα (sIL-15Rα). In some embodiments, the nucleic acid sequence encoding the fusion protein may comprise a sequence encoding amino acids 21-205 of IL-15Rα. In some embodiments, the nucleic acid sequence encoding the fusion protein may comprise a sequence encoding amino acids 21-205 of SEQ ID NO: 1247. In some embodiments, the nucleic acid sequence encoding the fusion protein may comprise a sequence encoding a sequence of SEQ ID NO: 1249.

In some embodiments, the nucleic acid sequence encoding the fusion protein may further comprise a sequence encoding an epitope tag. An epitope tag as described herein can be a peptide epitope tag or a protein epitope tag. Examples of a peptide epitope tag includes, but are not limited to, 6×His (also known as His-tag or hexahistidine tag), FLAG (e.g., 3×FLAG), HA, Myc, and V5. Examples of a protein epitope tag include, but are not limited to, green fluorescent protein (GFP), glutathione-S-transferase (GST), β-galactosidase (β-GAL), Luciferase, Maltose Binding Protein (MBP), Red Fluorescence Protein (RFP), and Vesicular Stomatitis Virus Glycoprotein (VSV-G). In some embodiments, the nucleic acid sequence encoding the fusion protein further comprises a sequence encoding a FLAG tag. In some embodiments, the nucleic acid sequence encoding the fusion protein further comprises a sequence encoding a 3×FLAG tag. In some embodiments, the nucleic acid sequence encoding the fusion protein further comprises a sequence encoding a sequence of SEQ ID NO: 1255.

In some embodiments, the fusion protein is expressed on cell surface when expressed from the recombinant nucleic acid molecule described herein in a T cell. In some embodiments, the fusion protein is secreted when expressed from the recombinant nucleic acid molecule described herein in a T cell.

Disclosed herein, in some embodiments, are recombinant nucleic acid molecules comprising a first nucleic acid sequence encoding a TFP described herein, a second nucleic acid sequence encoding an IL-15 polypeptide or a fragment thereof, and a third nucleic acid sequence encoding an agent that can enhance the activity of a modified T cell expressing the TFP. In some embodiments, the third nucleic acid sequence is included in a separate nucleic acid sequence. In some embodiments, the third nucleic acid sequence is included in the same nucleic acid molecule as the first nucleic acid sequence or the second nucleic acid sequence, or the first and the second nucleic acid sequences. For example, in one embodiment, the agent that can enhance the activity of a modified T cell can be a PD-1 polypeptide. In these embodiments, the PD-1 polypeptide may be operably linked to the N-terminus of an intracellular domain of a costimulatory polypeptide via the C-terminus of the PD-1 polypeptide. For example, in another embodiment, the agent that can enhance the activity of a modified T cell can be an anti-PD-1 antibody, or antigen binding fragment thereof. In this embodiment, the anti-PD-1 antibody or antigen binding fragment thereof may be operably linked to the N-terminus of an intracellular domain of a costimulatory polypeptide via the C-terminus of the anti-PD-1 antibody, or antigen binding fragment thereof. In some embodiments, the PD-1 polypeptide or anti-PD-1 antibody is linked to the intracellular domain of the costimulatory polypeptide via the transmembrane domain of PD-1. In some embodiments, the costimulatory polypeptide is selected from the group consisting of OX40, CD2, CD27, CDS, ICAM-1, ICOS (CD278), 4-1BB (CD137), GITR, CD28, CD30, CD40, BAFFR, HVEM, CD7, LIGHT, NKG2C, SLAMF7, NKp80, CD160, CD226, FcγRI, FcγRII, and FcγRIII.

Disclosed herein, in some embodiments, are recombinant nucleic acid molecules comprising a first nucleic acid sequence encoding a TFP described herein and a second nucleic acid sequence encoding an IL-15Rα polypeptide or a fragment thereof, wherein the first nucleic acid sequence and the second nucleic acid sequence are operatively linked by a first linker described herein, and wherein the second nucleic acid sequence further encodes an agent that can enhance the activity of a modified T cell expressing the TFP. For example, the agent can be an agent that can inhibit an inhibitory molecule that can decrease the ability of a T cell expressing a TFP to mount an immune effector response. In some embodiments, the agent which inhibits an inhibitory molecule comprises a first polypeptide, e.g., an inhibitory molecule, associated with a second polypeptide that provides a positive signal to the cell, e.g., an intracellular signaling domain described herein. In one embodiment, the agent may comprise a first polypeptide, e.g., of an inhibitory molecule such as PD-1, LAG3, CTLA4, CD160, BTLA, LAIR1, TIM3, 2B4, and TIGIT, or a fragment of any of these (e.g., at least a portion of an extracellular domain of any of these), and a second polypeptide which is an intracellular signaling domain described herein (e.g., comprising a costimulatory domain (e.g., 4-1BB, CD27, or CD28, as described herein)) and/or a primary signaling domain (e.g., IL-15Rα described herein). In some embodiments, the second nucleic acid sequence further comprises a sequence encoding PD-1 or a fragment thereof. In some embodiments, the second nucleic acid sequence comprises a sequence encoding the extracellular domain of PD-1. In some embodiments, the second nucleic acid sequence comprises a sequence encoding the extracellular domain and transmembrane domain of PD-1. In some embodiments, the second nucleic acid sequence may further comprise a sequence encoding CD28 or a fragment thereof. In some embodiments, the second nucleic acid sequence comprises a sequence encoding the intracellular domain of CD28. In some embodiments, the second nucleic acid sequence comprises a sequence encoding a fusion protein comprising the PD-1 extracellular domain and transmembrane domain linked to the CD28 intracellular domain linked to IL-15Rα. In some embodiments, the CD28 intracellular domain is linked to the intracellular domain of IL-15Rα. In some embodiments, the intracellular domain of IL-15Rα comprises amino acids 229-267 of IL-15Rα. In some embodiments, the intracellular domain of IL-15Rα comprises amino acids 229-267 of SEQ ID NO: 1247. In some embodiments the intracellular domain of IL-15Rα comprises a sequence of SEQ ID NO: 1248.

In some embodiments, the second nucleic acid sequence encoding PD-1, or a fragment thereof may comprise a nucleic acid sequence encoding any one of the sequence listed in Table 10 or a fragment thereof. In some embodiments, the second nucleic acid sequence encoding PD-1, or a fragment thereof may comprise a nucleic acid sequence encoding a sequence of SEQ ID NO: 1256. In some embodiments, the second nucleic acid sequence encoding PD-1, or a fragment thereof may comprise a nucleic acid sequence encoding a sequence of SEQ ID NO: 1257. In some embodiments, the second nucleic acid sequence encoding PD-1, or a fragment thereof may comprise a nucleic acid sequence encoding a sequence of SEQ ID NO: 1258. In some embodiments, the second nucleic acid sequence encoding PD-1, or a fragment thereof may comprise a nucleic acid sequence encoding a sequence of SEQ ID NO: 1259. In some embodiments, the nucleic acid sequence encoding the transmembrane domain of PD-1 may comprise a nucleic acid sequence encoding a sequence of SEQ ID NO: 1239. In some embodiments, the nucleic acid sequence encoding the intracellular domain of CD28 may comprise a nucleic acid sequence encoding a sequence of SEQ ID NO: 1260. In some embodiments, the intracellular domain of IL-15Rα comprises amino acids 229-267 of IL-15Rα. In some embodiments, the nucleic acid encoding the intracellular domain of IL-15Rα comprises a nucleic acid encoding amino acids 229-267 of SEQ ID NO: 1247. In some embodiments, the nucleic acid encoding the intracellular domain of IL-15Rα comprises a nucleic acid encoding a sequence of SEQ ID NO: 1248.

Disclosed herein, in some embodiments, are recombinant nucleic acid molecules comprising a first nucleic acid sequence encoding a TFP described herein, a second nucleic acid sequence encoding an IL-15Rα polypeptide or a fragment thereof and an agent that can enhance the activity of a modified T cell expressing the TFP described herein, and a third nucleic acid sequence encoding an IL-15 polypeptide or a fragment thereof. In some embodiments, the first nucleic acid sequence and the second nucleic acid sequence are included in two separate nucleic acid sequences. In some embodiments, the first nucleic acid sequence and the second nucleic acid sequence are included in a single nucleic acid sequence. In some embodiments, the first nucleic acid sequence and the second nucleic acid sequence are operatively linked by a first linker described herein. In some embodiments, the third nucleic acid sequence is included in a separate nucleic acid sequence. In some embodiments, the third nucleic acid sequence is included in the same nucleic acid molecule as the first nucleic acid sequence or the second nucleic acid sequence, or the first and the second nucleic acid sequences. In some embodiments, the third nucleic acid sequence encoding the IL-15 polypeptide may comprise a sequence encoding amino acids 1-29 of IL-15. In some embodiments, the third nucleic acid sequence encoding the IL-15 polypeptide may comprise a sequence encoding amino acids 1-29 of SEQ ID NO: 1245. In some embodiments, the third nucleic acid sequence encoding the IL-15 polypeptide may comprise a sequence encoding a sequence of SEQ ID NO: 1246. In some embodiments, the third nucleic acid sequence encoding the IL-15 polypeptide may comprise a sequence encoding amino acids 30-162 of IL-15. In some embodiments, the third nucleic acid sequence encoding the IL-15 polypeptide may comprise a sequence encoding amino acids 30-162 of SEQ ID NO: 1245. In some embodiments, the third nucleic acid sequence encoding the IL-15 polypeptide may comprise a sequence encoding any one of the sequence listed in Table 11 or a fragment thereof. In some embodiments, the third nucleic acid sequence encoding the IL-15 polypeptide may comprise a sequence encoding a sequence of SEQ ID NO: 1242. In some embodiments, the IL-15 polypeptide is secreted when expressed in a T cell. In some embodiments, the third nucleic acid sequence encoding the IL-15 polypeptide may comprise a sequence encoding amino acids 1-162 of IL-15. In some embodiments, the third nucleic acid sequence encoding the IL-15 polypeptide may comprise a sequence encoding amino acids 1-162 of SEQ ID NO: 1245. In some embodiments, the third nucleic acid sequence encoding the IL-15 polypeptide may comprise a sequence encoding a sequence of SEQ ID NO: 1246 and a sequence of SEQ ID NO: 1242.

Disclosed herein in some embodiments, are recombinant nucleic acid molecules comprising a nucleic acid sequence encoding a TFP described herein, a nucleic acid sequence encoding a PD-1 polypeptide or a fragment thereof, a nucleic acid sequence encoding CD28 polypeptide or a fragment thereof, a nucleic acid sequence encoding an IL-15Rα or a fragment thereof described herein, and a nucleic acid sequence encoding an IL-15 polypeptide, or a fragment thereof described herein. In some embodiments, the nucleic acid sequence encoding a TFP may comprise a sequence encoding CSF2RA signal peptide. In some embodiments, the nucleic acid sequence encoding a TFP may comprise a nucleic acid sequence encoding a sequence of SEQ ID NO: 1234. In some embodiments, the nucleic acid sequence encoding a TFP may comprise a sequence encoding CD3ε. In some embodiments, the nucleic acid sequence encoding a TFP may comprise a nucleic acid sequence encoding a sequence of SEQ ID NO: 1235. In some embodiments, the nucleic acid sequence encoding the PD-1 polypeptide, or a fragment thereof comprises a sequence encoding PD-1 signal peptide. In some embodiments, the nucleic acid sequence encoding the PD-1 polypeptide, or a fragment thereof comprises a nucleic acid sequence encoding any one of the sequence listed in Table 10 or a fragment thereof. In some embodiments, the nucleic acid sequence encoding the PD-1 polypeptide, or a fragment thereof comprises a nucleic acid sequence encoding a sequence of SEQ ID NO: 1256. In some embodiments, the nucleic acid sequence encoding the PD-1 polypeptide, or a fragment thereof comprises a sequence encoding PD-1 N-Loop. In some embodiments, the nucleic acid sequence encoding the PD-1 polypeptide, or a fragment thereof comprises a nucleic acid sequence encoding a sequence of SEQ ID NO: 1257. In some embodiments, the nucleic acid sequence encoding the PD-1 polypeptide, or a fragment thereof comprises a sequence encoding PD-1 IgV. In some embodiments, the nucleic acid sequence encoding the PD-1 polypeptide, or a fragment thereof comprises a nucleic acid sequence encoding a sequence of SEQ ID NO: 1258. In some embodiments, the nucleic acid sequence encoding the PD-1 polypeptide, or a fragment thereof comprises a sequence encoding PD-1 Stalk. In some embodiments, the nucleic acid sequence encoding the PD-1 polypeptide, or a fragment thereof comprises a nucleic acid sequence encoding a sequence of SEQ ID NO: 1259. In some embodiments, the nucleic acid sequence encoding the PD-1 polypeptide, or a fragment thereof comprises a sequence encoding PD-1 transmembrane domain. In some embodiments, the nucleic acid sequence encoding the PD-1 polypeptide, or a fragment thereof comprises a nucleic acid sequence encoding a sequence of SEQ ID NO: 1239. In some embodiments, the nucleic acid sequence encoding the CD28 polypeptide or a fragment thereof comprises a sequence encoding CD28 intracellular domain. In some embodiments, the nucleic acid sequence encoding the PD-1 polypeptide, or a fragment thereof comprises a nucleic acid sequence encoding a sequence of SEQ ID NO: 1260. In some embodiments, the nucleic acid sequence encoding IL-15Rα polypeptide or fragment thereof comprise a sequence encoding amino acids 229-267 of IL-15Rα. In some embodiments, the nucleic acid sequence encoding IL-15Rα polypeptide or fragment thereof may comprise a nucleic acid sequence encoding a sequence of SEQ ID NO: 1248. In some embodiments, the nucleic acid sequence encoding IL-15 polypeptide or fragment thereof comprise a sequence encoding amino acids 1-29 of IL-15. In some embodiments, the nucleic acid sequence encoding IL-15 polypeptide or fragment thereof comprise a nucleic acid sequence encoding a sequence of SEQ ID NO: 1246. In some embodiments, the nucleic acid sequence encoding IL-15 polypeptide or fragment thereof may comprise a sequence encoding amino acids 30-162 of IL-15. In some embodiments, the nucleic acid sequence encoding IL-15 polypeptide or fragment thereof may comprise a nucleic acid sequence encoding any one of the sequence listed in Table II or a fragment thereof. In some embodiments, the nucleic acid sequence encoding IL-15 polypeptide or fragment thereof may comprise a nucleic acid sequence encoding a sequence of SEQ ID NO: 1242. In some embodiments, the nucleic acid sequence encoding the TFP and the nucleic acid sequence encoding the PD-1 polypeptide, or a fragment thereof are operatively linked by a T2A linker. In some embodiments, the T2A linker may comprise a sequence of SEQ ID NO: 1238. In some embodiments, the nucleic acid sequence encoding the IL-15Rα or a fragment thereof and the nucleic acid sequence encoding the IL-15 polypeptide, or a fragment thereof are operatively linked by a P2A linker. In some embodiments, the P2A linker may comprise a sequence of SEQ ID NO: 1261.

Disclosed herein in some embodiments, are recombinant nucleic acid molecules comprising a nucleic acid sequence encoding a TFP described herein, a nucleic acid sequence encoding a PD-1 polypeptide or a fragment thereof, a nucleic acid sequence encoding CD28 polypeptide or a fragment thereof, and a nucleic acid sequence encoding an IL-15Rα or a fragment thereof described herein. In some embodiments, the nucleic acid sequence encoding a TFP may comprise a sequence encoding CSF2RA signal peptide. In some embodiments, the nucleic acid sequence encoding a TFP may comprise a nucleic acid sequence encoding a sequence of SEQ ID NO: 1234. In some embodiments, the nucleic acid sequence encoding a TFP may comprise a sequence encoding CD3ε. In some embodiments, the nucleic acid sequence encoding a TFP may comprise a nucleic acid sequence encoding a sequence of SEQ ID NO: 1235. In some embodiments, the nucleic acid sequence encoding the PD-1 polypeptide, or a fragment thereof comprises a sequence encoding PD-1 signal peptide. In some embodiments, the nucleic acid sequence encoding the PD-1 polypeptide, or a fragment thereof comprises a nucleic acid sequence encoding any one of the sequence listed in Table 10 or a fragment thereof. In some embodiments, the nucleic acid sequence encoding the PD-1 polypeptide, or a fragment thereof comprises a nucleic acid sequence encoding a sequence of SEQ ID NO: 1256. In some embodiments, the nucleic acid sequence encoding the PD-1 polypeptide, or a fragment thereof comprises a sequence encoding PD-1 N-Loop. In some embodiments, the nucleic acid sequence encoding the PD-1 polypeptide, or a fragment thereof comprises a nucleic acid sequence encoding a sequence of SEQ ID NO: 1257. In some embodiments, the nucleic acid sequence encoding the PD-1 polypeptide, or a fragment thereof comprises a sequence encoding PD-1 IgV. In some embodiments, the nucleic acid sequence encoding the PD-1 polypeptide, or a fragment thereof comprises a nucleic acid sequence encoding a sequence of SEQ ID NO: 1258. In some embodiments, the nucleic acid sequence encoding the PD-1 polypeptide, or a fragment thereof comprises a sequence encoding PD-1 Stalk. In some embodiments, the nucleic acid sequence encoding the PD-1 polypeptide, or a fragment thereof comprises a nucleic acid sequence encoding a sequence of SEQ ID NO: 1259. In some embodiments, the nucleic acid sequence encoding the PD-1 polypeptide, or a fragment thereof comprises a sequence encoding PD-1 transmembrane domain. In some embodiments, the nucleic acid sequence encoding the PD-1 polypeptide, or a fragment thereof comprises a nucleic acid sequence encoding a sequence of SEQ ID NO: 1239. In some embodiments, the nucleic acid sequence encoding the CD28 polypeptide or a fragment thereof comprises a sequence encoding CD28 intracellular domain. In some embodiments, the nucleic acid sequence encoding the PD-1 polypeptide, or a fragment thereof comprises a nucleic acid sequence encoding a sequence of SEQ ID NO: 1260. In some embodiments, the nucleic acid sequence encoding IL-15Rα polypeptide or fragment thereof comprise a sequence encoding amino acids 229-267 of IL-15Rα. In some embodiments, the nucleic acid sequence encoding IL-15Rα polypeptide or fragment thereof may comprise a nucleic acid sequence encoding a sequence of SEQ ID NO: 1248. In some embodiments, the nucleic acid sequence encoding the TFP and the nucleic acid sequence encoding the PD-1 polypeptide, or a fragment thereof are operatively linked by a T2A linker. In some embodiments, the T2A linker may comprise a sequence of SEQ ID NO: 1238.

Disclosed herein in some embodiments, are recombinant nucleic acid molecules comprising a nucleic acid sequence encoding a TFP described herein, a nucleic acid sequence encoding an IL-15 polypeptide, or a fragment thereof described herein, and a nucleic acid sequence encoding an IL-15Rα or a fragment thereof described herein. In some embodiments, the nucleic acid sequence encoding a TFP may comprise a sequence encoding CSF2RA signal peptide. In some embodiments, the nucleic acid sequence encoding a TFP may comprise a nucleic acid sequence encoding a sequence of SEQ ID NO: 1234. In some embodiments, the nucleic acid sequence encoding a TFP may comprise a sequence encoding CD3ε. In some embodiments, the nucleic acid sequence encoding a TFP may comprise a nucleic acid sequence encoding a sequence of SEQ ID NO: 1235. In some embodiments, the nucleic acid sequence encoding IL-15 polypeptide or fragment thereof comprise a sequence encoding amino acids 1-29 of IL-15. In some embodiments, the nucleic acid sequence encoding IL-15 polypeptide or fragment thereof comprise a nucleic acid sequence encoding a sequence of SEQ ID NO: 1246. In some embodiments, the nucleic acid sequence encoding IL-15 polypeptide or fragment thereof may comprise a sequence encoding amino acids 30-162 of IL-15. In some embodiments, the nucleic acid sequence encoding IL-15 polypeptide or fragment thereof may comprise a nucleic acid sequence encoding any one of the sequence listed in Table 11 or a fragment thereof. In some embodiments, the nucleic acid sequence encoding IL-15 polypeptide or fragment thereof may comprise a nucleic acid sequence encoding a sequence of SEQ ID NO: 1242. In some embodiments, the nucleic acid sequence encoding IL-15Rα polypeptide or fragment thereof comprise a sequence encoding amino acids 21-205 of IL-15Rα. In some embodiments, the nucleic acid sequence encoding IL-15Rα polypeptide or fragment thereof may comprise a nucleic acid sequence encoding a sequence of SEQ ID NO: 1249. In some embodiments, the nucleic acid sequence encoding the TFP and the nucleic acid sequence encoding the IL-15 polypeptide, or a fragment thereof are operatively linked by a T2A linker. In some embodiments, the T2A linker may comprise a sequence of SEQ ID NO: 1238. In some embodiments, the nucleic acid sequence encoding the HL-15 polypeptide or a fragment thereof and the nucleic acid sequence encoding the IL- 15Rα or a fragment thereof are operatively linked by a non-cleavable linker. In some embodiments, the non-cleavable linker may comprise a sequence of SEQ ID NO: 1243.

Disclosed herein in some embodiments, are recombinant nucleic acid molecules comprising a nucleic acid sequence encoding a TFP described herein and a nucleic acid sequence encoding an IL-15 polypeptide, or a fragment thereof described herein. In some embodiments, the nucleic acid sequence encoding a TFP may comprise a sequence encoding CSF2RA signal peptide. In some embodiments, the nucleic acid sequence encoding a TFP may comprise a nucleic acid sequence encoding a sequence of SEQ ID NO: 1234. In some embodiments, the nucleic acid sequence encoding a TFP may comprise a sequence encoding CD3ε. In some embodiments, the nucleic acid sequence encoding a TFP may comprise a nucleic acid sequence encoding a sequence of SEQ ID NO: 1235. In some embodiments, the nucleic acid sequence encoding IL-15 polypeptide or fragment thereof comprise a sequence encoding amino acids 1-29 of IL-15. In some embodiments, the nucleic acid sequence encoding IL-15 polypeptide or fragment thereof comprise a nucleic acid sequence encoding a sequence of SEQ ID NO: 1246. In some embodiments, the nucleic acid sequence encoding IL-15 polypeptide or fragment thereof may comprise a sequence encoding amino acids 30-162 of IL-15. In some embodiments, the nucleic acid sequence encoding IL-15 polypeptide or fragment thereof may comprise a nucleic acid sequence encoding any one of the sequence listed in Table 11 or a fragment thereof. In some embodiments, the nucleic acid sequence encoding IL-15 polypeptide or fragment thereof may comprise a nucleic acid sequence encoding a sequence of SEQ ID NO: 1242. In some embodiments, the nucleic acid sequence encoding the TFP and the nucleic acid sequence encoding the IL-15 polypeptide, or a fragment thereof are operatively linked by a T2A linker. In some embodiments, the T2A linker may comprise a sequence of SEQ ID NO: 1238.

Disclosed herein in some embodiments, are recombinant nucleic acid molecules comprising a nucleic acid sequence encoding a TFP described herein, a nucleic acid sequence encoding an IL-15 polypeptide, or a fragment thereof described herein, and a nucleic acid sequence encoding an IL-15Rα or a fragment thereof described herein. In some embodiments, the nucleic acid sequence encoding a TFP may comprise a sequence encoding CSF2RA signal peptide. In some embodiments, the nucleic acid sequence encoding a TFP may comprise a nucleic acid sequence encoding a sequence of SEQ ID NO: 1234. In some embodiments, the nucleic acid sequence encoding a TFP may comprise a sequence encoding CD3ε. In some embodiments, the nucleic acid sequence encoding a TFP may comprise a nucleic acid sequence encoding a sequence of SEQ ID NO: 1235. In some embodiments, the nucleic acid sequence encoding IL-15 polypeptide or fragment thereof comprise a sequence encoding amino acids 1-29 of IL-15. In some embodiments, the nucleic acid sequence encoding HL-15 polypeptide or fragment thereof comprise a nucleic acid sequence encoding a sequence of SEQ ID NO: 1246. In some embodiments, the nucleic acid sequence encoding IL-15 polypeptide or fragment thereof may comprise a sequence encoding amino acids 30-162 of IL-15. In some embodiments, the nucleic acid sequence encoding IL-15 polypeptide or fragment thereof may comprise a nucleic acid sequence encoding any one of the sequence listed in Table 11 or a fragment thereof. In some embodiments, the nucleic acid sequence encoding IL-15 polypeptide or fragment thereof may comprise a nucleic acid sequence encoding a sequence of SEQ ID NO: 1242. In some embodiments, the nucleic acid sequence encoding IL-15Rα polypeptide or fragment thereof comprise a sequence encoding amino acids 31-95 of IL-15Rα. In some embodiments, the nucleic acid sequence encoding IL-15Rα polypeptide or fragment thereof may comprise a nucleic acid sequence encoding a sequence of SEQ ID NO: 1250. In some embodiments, the nucleic acid sequence encoding IL-15Rα polypeptide or fragment thereof comprise a sequence encoding amino acids 96-267 of IL-15Rα. In some embodiments, the nucleic acid sequence encoding IL-15Rα polypeptide or fragment thereof may comprise a nucleic acid sequence encoding a sequence of SEQ ID NO: 1251. In some embodiments, the nucleic acid sequence encoding the TFP and the nucleic acid sequence encoding the IL-15 polypeptide, or a fragment thereof are operatively linked by a T2A linker. In some embodiments, the T2A linker may comprise a sequence of SEQ ID NO: 1238. In some embodiments, the nucleic acid sequence encoding the IL-15 polypeptide or a fragment thereof and the nucleic acid sequence encoding the IL-15Rα or a fragment thereof are operatively linked by a non-cleavable linker. In some embodiments, the non-cleavable linker may comprise a sequence of SEQ ID NO: 1243.

In some embodiments, recombinant nucleic acid molecules described herein further comprise a leader sequence. In some embodiments, the recombinant nucleic acid molecule is selected from the group consisting of a DNA and an RNA. In some embodiments, the recombinant nucleic acid molecule is an mRNA. In some embodiments, the recombinant nucleic acid molecule is a circRNA. In some embodiments, the recombinant nucleic acid molecule comprises a nucleic acid analog. In some embodiments, the nucleic acid analog is not in an encoding sequence of the recombinant nucleic acid. In some embodiments, the nucleic analog is selected from the group consisting of 2'-O-methyl, 2'-O-methoxyethyl (2'-O-MOE), 2'-O-aminopropyl, 2'-deoxy, T-deoxy-2'-fluoro, 2'-O-aminopropyl (2'-O-AP), 2'-O-dimethylaminoethyl (2'-O-DMAOE), 2'-O-dimethylaminopropyl (2'-O-DMAP), T-O-dimethylaminoethyloxyethyl (2'-O-DMAEOE), 2'-O—N-methylacetamido (2'-O-NMA) modified, a locked nucleic acid (LNA), an ethylene nucleic acid (ENA), a peptide nucleic acid (PNA), a 1',5'-anhydrohexitol nucleic acid (HNA), a morpholino, a methylphosphonate nucleotide, a thiolphosphonate nucleotide, and a 2'-fluoro N3-P5'-phosphoramidite. In some embodiments, the recombinant nucleic acid molecule further comprises a leader sequence. In some embodiments, the recombinant nucleic acid molecule further comprises a promoter sequence. In some embodiments, the recombinant nucleic acid molecule further comprises a sequence encoding a poly(A) tail. In some embodiments, the recombinant nucleic acid molecule further comprises a 3'UTR sequence. In some embodiments, the recombinant nucleic acid molecule is an isolated nucleic acid or a non-naturally occurring nucleic acid. In some embodiments, the nucleic acid is an in vitro transcribed nucleic acid.

The present disclosure further provides a vector comprising a nucleic acid molecule encoding a TFP described herein, an IL-15 polypeptide or a fragment described herein, and/or IL-15Rα polypeptide or a fragment described herein. In one aspect, a vector encoding a TFP described herein, an IL-15 polypeptide or a fragment described herein, and/or IL-15Rα polypeptide or a fragment described herein can be directly transduced into a cell, e.g., a T cell. In one aspect, the vector is a cloning or expression vector, e.g., a vector including, but not limited to, one or more plasmids (e.g., expression plasmids, cloning vectors, minicircles, minivectors, double minute chromosomes), retroviral and lentiviral vector constructs. In one aspect, the vector is capable of expressing the TFP construct, an IL-15 construct, and/or an IL-15Rα construct in mammalian T cells. In one aspect, the mammalian T cell is a human T cell.

In some embodiments, the recombinant nucleic acid molecule as described herein comprises a sequence encoding an amino acid sequence having at least about 50%, 55%, 60%, 65%, 70%, 75%, 80%, 85%, 90%, 95%, 98%, 99% or more sequence identity to any one of the amino acid sequences listed in Table 12. In some embodiments, the recombinant nucleic acid molecule as described herein comprises a sequence encoding any one of the amino acid sequences listed in Table 12. In some embodiments, the recombinant nucleic acid molecule as described herein comprises a sequence encoding an amino acid sequence having at least about 50%, 55%, 60%, 65%, 70%, 75%, 80%, 85%, 90%, 95%, 98%, 99% or more sequence identity to any one of the amino acid sequences selected from SEQ ID NOs: 1233, 1236, 1240, and 1264. In some embodiments, the recombinant nucleic acid molecule as described herein comprises a sequence encoding any one of the amino acid sequences selected from SEQ ID NOs: 1233, 1236, 1240, and 1264.

Vectors

In some embodiments, the instant invention provides vectors comprising the recombinant nucleic acid(s) encoding the TFP and/or additional molecules of interest (e.g., a protein or proteins to be secreted by the TFP T cell). In some instances, the vector is selected from the group consisting of a DNA, a RNA, a plasmid, a lentivirus vector, adenoviral vector, an adeno-associated viral vector (AAV), a Rous sarcoma viral (RSV) vector, or a retrovirus vector. In some instances, the vector is an AAV6 vector. In some instances, the vector further comprises a promoter. In some instances, the vector is an in vitro transcribed vector.

The nucleic acid sequences coding for the desired molecules can be obtained using recombinant methods known in the art, such as, for example by screening libraries from cells expressing the gene, by deriving the gene from a vector known to include the same, or by isolating directly from cells and tissues containing the same, using standard techniques. Alternatively, the gene of interest can be produced synthetically, rather than cloned.

The present disclosure also provides vectors in which a DNA of the present disclosure is inserted. Vectors derived from retroviruses such as the lentivirus are suitable tools to achieve long-term gene transfer since they allow long-term, stable integration of a transgene and its propagation in daughter cells. Lentiviral vectors have the added advantage over vectors derived from onco-retroviruses such as murine leukemia viruses in that they can transduce non-proliferating cells, such as hepatocytes. They also have the added advantage of low immunogenicity.

In another embodiment, the vector comprising the nucleic acid encoding the desired TFP of the present disclosure is an adenoviral vector (A5/35). In another embodiment, the expression of nucleic acids encoding TFPs can be accomplished using of transposons such as sleeping beauty, crisper, CAS9, and zinc finger nucleases. See, e.g., June et al., 2009 *Nature Reviews Immunology* 9.10: 704-716, which is incorporated herein by reference.

The TFP of the present invention may be used in multicistronic vectors or vectors expressing several proteins in the same transcriptional unit. Such vectors may use internal ribosomal entry sites (IRES). Since IRES are not functional in all hosts and do not allow for the stoichiometric expression of multiple protein, self-cleaving peptides may be used instead. For example, several viral peptides are cleaved during translation and allow for the expression of multiple proteins form a single transcriptional unit. Such peptides include 2A-peptides, or 2A-like sequences, from members of the Picornaviridae virus family. See for example Szymczak et al., 2004, *Nature Biotechnology;* 22:589-594. In some embodiments, the recombinant nucleic acid described herein encodes the TFP in frame with the agent, with the two sequences separated by a self-cleaving peptide, such as a 2A sequence, or a T2A sequence.

The expression constructs of the present disclosure may also be used for nucleic acid immunization and gene therapy, using standard gene delivery protocols. Methods for gene delivery are known in the art (see, e.g., U.S. Pat. Nos. 5,399,346, 5,580,859, 5,589,466, each of which is incorporated by reference herein in their entireties). In another embodiment, the present disclosure provides a gene therapy vector.

The nucleic acid can be cloned into a number of types of vectors. For example, the nucleic acid can be cloned into a vector including, but not limited to a plasmid, a phagemid, a phage derivative, an animal virus, and a cosmid. Vectors of particular interest include expression vectors, replication vectors, probe generation vectors, and sequencing vectors.

Further, the expression vector may be provided to a cell in the form of a viral vector. Viral vector technology is well known in the art and is described, for example, in Sambrook et al., 2012, Molecular Cloning: A Laboratory Manual, volumes 1-4, Cold Spring Harbor Press, NY), and in other virology and molecular biology manuals. Viruses, which are useful as vectors include, but are not limited to, retroviruses, adenoviruses, adeno-associated viruses, herpes viruses, and lentiviruses. In general, a suitable vector contains an origin of replication functional in at least one organism, a promoter sequence, convenient restriction endonuclease sites, and one or more selectable markers, (e.g., WO 01/96584; WO 01/29058; and U.S. Pat. No. 6,326,193).

A number of virally based systems have been developed for gene transfer into mammalian cells. For example, retroviruses provide a convenient platform for gene delivery systems. A selected gene can be inserted into a vector and packaged in retroviral particles using techniques known in the art. The recombinant virus can then be isolated and delivered to cells of the subject either in vivo or ex vivo. A number of retroviral systems are known in the art. In some embodiments, adenovirus vectors are used. A number of adenovirus vectors are known in the art. In one embodiment, lentivirus vectors are used.

Additional promoter elements, e.g., enhancers, regulate the frequency of transcriptional initiation. Typically, these are located in the region 30-110 bp upstream of the start site, although a number of promoters have been shown to contain functional elements downstream of the start site as well. The spacing between promoter elements frequently is flexible, so that promoter function is preserved when elements are inverted or moved relative to one another. In the thymidine kinase (tk) promoter, the spacing between promoter elements can be increased to 50 bp apart before activity begins to decline. Depending on the promoter, it appears that individual elements can function either cooperatively or independently to activate transcription.

An example of a promoter that is capable of expressing a TFP transgene in a mammalian T cell is the EF1a promoter. The native EFla promoter drives expression of the alpha subunit of the elongation factor-1 complex, which is responsible for the enzymatic delivery of aminoacyl tRNAs to the ribosome. The EF1a promoter has been extensively used in mammalian expression plasmids and has been shown to be effective in driving TFP expression from transgenes cloned into a lentiviral vector (see, e.g., Milone et al., Mol. Ther.

17(8): 1453-1464 (2009)). Another example of a promoter is the immediate early cytomegalovirus (CMV) promoter sequence. This promoter sequence is a strong constitutive promoter sequence capable of driving high levels of expression of any polynucleotide sequence operatively linked thereto. However, other constitutive promoter sequences may also be used, including, but not limited to the simian virus 40 (SV40) early promoter, mouse mammary tumor virus (MMTV), human immunodeficiency virus (HIV) long terminal repeat (LTR) promoter, MoMuLV promoter, an avian leukemia virus promoter, an Epstein-Barr virus immediate early promoter, a Rous sarcoma virus promoter, as well as human gene promoters such as, but not limited to, the actin promoter, the myosin promoter, the elongation factor-1a promoter, the hemoglobin promoter, and the creatine kinase promoter. Further, the present disclosure should not be limited to the use of constitutive promoters. Inducible promoters are also contemplated as part of the present disclosure. The use of an inducible promoter provides a molecular switch capable of turning on expression of the polynucleotide sequence which it is operatively linked when such expression is desired or turning off the expression when expression is not desired. Examples of inducible promoters include, but are not limited to a metallothionine promoter, a glucocorticoid promoter, a progesterone promoter, and a tetracycline-regulated promoter.

In order to assess the expression of a TFP polypeptide or portions thereof, the expression vector to be introduced into a cell can also contain either a selectable marker gene or a reporter gene or both to facilitate identification and selection of expressing cells from the population of cells sought to be transfected or infected through viral vectors. In other aspects, the selectable marker may be carried on a separate piece of DNA and used in a co-transfection procedure. Both selectable markers and reporter genes may be flanked with appropriate regulatory sequences to enable expression in the host cells. Useful selectable markers include, for example, antibiotic-resistance genes, such as neo and the like.

Reporter genes are used for identifying potentially transfected cells and for evaluating the functionality of regulatory sequences. In general, a reporter gene is a gene that is not present in or expressed by the recipient organism or tissue and that encodes a polypeptide whose expression is manifested by some easily detectable property, e.g., enzymatic activity. Expression of the reporter gene is assayed at a suitable time after the DNA has been introduced into the recipient cells. Suitable reporter genes may include genes encoding luciferase, beta-galactosidase, chloramphenicol acetyl transferase, secreted alkaline phosphatase, or the green fluorescent protein gene (e.g., Ui-Tei et al., 2000 *FEBSLetters* 479: 79-82). Suitable expression systems are well known and may be prepared using known techniques or obtained commercially. In general, the construct with the minimal 5' flanking region showing the highest level of expression of reporter gene is identified as the promoter. Such promoter regions may be linked to a reporter gene and used to evaluate agents for the ability to modulate promoter-driven transcription.

Methods of introducing and expressing genes into a cell are known in the art. In the context of an expression vector, the vector can be readily introduced into a host cell, e.g., mammalian, bacterial, yeast, or insect cell by any method in the art. For example, the expression vector can be transferred into a host cell by physical, chemical, or biological means.

Physical methods for introducing a polynucleotide into a host cell include calcium phosphate precipitation, lipofection, particle bombardment, microinjection, electroporation, and the like. Methods for producing cells comprising vectors and/or exogenous nucleic acids are well-known in the art. See, for example, Sambrook et al., 2012, Molecular Cloning: A Laboratory Manual, volumes 1-4, Cold Spring Harbor Press, NY). A preferred method for the introduction of a polynucleotide into a host cell is calcium phosphate transfection Biological methods for introducing a polynucleotide of interest into a host cell include the use of DNA and RNA vectors. Viral vectors, and especially retroviral vectors, have become the most widely used method for inserting genes into mammalian, e.g., human cells. Other viral vectors can be derived from lentivirus, poxviruses, herpes simplex virus I, adenoviruses and adeno-associated viruses, and the like (see, e.g., U.S. Pat. Nos. 5,350,674 and 5,585,362.

Chemical means for introducing a polynucleotide into a host cell include colloidal dispersion systems, such as macromolecule complexes, nanocapsules, microspheres, beads, and lipid-based systems including oil-in-water emulsions, micelles, mixed micelles, and liposomes. An exemplary colloidal system for use as a delivery vehicle in vitro and in vivo is a liposome (e.g., an artificial membrane vesicle). Other methods of state-of-the-art targeted delivery of nucleic acids are available, such as delivery of polynucleotides with targeted nanoparticles or other suitable submicron sized delivery system.

In the case where a non-viral delivery system is utilized, an exemplary delivery vehicle is a liposome. The use of lipid formulations is contemplated for the introduction of the nucleic acids into a host cell (in vitro, ex vivo or in vivo). In another aspect, the nucleic acid may be associated with a lipid. The nucleic acid associated with a lipid may be encapsulated in the aqueous interior of a liposome, interspersed within the lipid bilayer of a liposome, attached to a liposome via a linking molecule that is associated with both the liposome and the oligonucleotide, entrapped in a liposome, complexed with a liposome, dispersed in a solution containing a lipid, mixed with a lipid, combined with a lipid, contained as a suspension in a lipid, contained or complexed with a micelle, or otherwise associated with a lipid. Lipid, lipid/DNA or lipid/expression vector associated compositions are not limited to any particular structure in solution. For example, they may be present in a bilayer structure, as micelles, or with a "collapsed" structure. They may also simply be interspersed in a solution, possibly forming aggregates that are not uniform in size or shape. Lipids are fatty substances which may be naturally occurring or synthetic lipids. For example, lipids include the fatty droplets that naturally occur in the cytoplasm as well as the class of compounds which contain long-chain aliphatic hydrocarbons and their derivatives, such as fatty acids, alcohols, amines, amino alcohols, and aldehydes.

Lipids suitable for use can be obtained from commercial sources. For example, dimyristyl phosphatidylcholine ("DMPC") can be obtained from Sigma, St. Louis, Mo.; dicetyl phosphate ("DCP") can be obtained from K & K Laboratories (Plainview, N.Y.); cholesterol ("Choi") can be obtained from Calbiochem-Behring; dimyristyl phosphatidylglycerol ("DMPG") and other lipids may be obtained from Avanti Polar Lipids, Inc. (Birmingham, Ala.). Stock solutions of lipids in chloroform or chloroform/methanol can be stored at about −20° C. Chloroform is used as the only solvent since it is more readily evaporated than methanol. "Liposome" is a generic term encompassing a variety of single and multilamellar lipid vehicles formed by the generation of enclosed lipid bilayers or aggregates. Liposomes can be characterized as having vesicular structures with a phospholipid bilayer membrane and an inner aqueous medium. Multilamellar liposomes have multiple lipid layers separated by aqueous medium. They form spontaneously when phospholipids are suspended in an excess of aqueous solution. The lipid components undergo self-rearrangement before the formation of closed structures and entrap water and dissolved solutes between the lipid bilayers (Ghosh et al., 1991 Glycobiology 5: 505-10). However, compositions that have different structures in solution than the normal vesicular structure are also encompassed. For example, the lipids may assume a micellar structure or merely exist as nonuniform aggregates of lipid molecules. Also contemplated are lipofectamine-nucleic acid complexes.

Regardless of the method used to introduce exogenous nucleic acids into a host cell or otherwise expose a cell to the inhibitor of the present disclosure, in order to confirm the presence of the recombinant DNA sequence in the host cell, a variety of assays may be performed. Such assays include, for example, "molecular biological" assays well known to those of skill in the art, such as Southern and Northern blotting, RT-PCR and PCR; "biochemical" assays, such as detecting the presence or absence of a particular peptide, e.g., by immunological means (ELISAs and western blots) or by assays described herein to identify agents falling within the scope of the present disclosure.

The present disclosure further provides a vector comprising a TFP encoding nucleic acid molecule. In one aspect, a TFP vector can be directly transduced into a cell, e.g., a T cell. In one aspect, the vector is a cloning or expression vector, e.g., a vector including, but not limited to, one or more plasmids (e.g., expression plasmids, cloning vectors, minicircles, minivectors, double minute chromosomes), retroviral and lentiviral vector constructs. In one aspect, the vector is capable of expressing the TFP construct in mammalian T cells. In one aspect, the mammalian T cell is a human T cell.

In some embodiments, TFP constructs are in a vector that further contains a sequence encoding an IL-15 peptide or an IL15-Rα peptide. The IL-15 may be encoded in the same open reading frame and separated by a self-cleaving peptide (e.g., a P2A or a T2A self-cleaving peptide). In some embodiments, the IL-15 peptide comprises a secreted IL-15. The secreted IL-15 can have the sequence of SEQ ID NO: 1242. In some embodiments, the IL-15 peptide is an IL-15-IL15Rα fusion. In some embodiments, IL-15Rα comprises the sequence of SEQ ID NO: 1251 or SEQ ID NO: 1247. In some embodiments, the IL-15-IL15Rα fusion comprises a linker followed by a sushi domain linking IL-15 and IL-15Rα. In some embodiments, the IL-15-IL15Rα fusion comprises the sequence of SEQ ID NO: 1253. In some embodiments, IL-15Rα peptide comprises the extracellular and transmembrane domain of PD-1. The extracellular and transmembrane domain of PD-1 can be fused to the intracellular domain of CD28. The IL-15Rα peptide can further comprise the intracellular domain of IL-15Rα fused to the C-terminus of CD28 (e.g., intracellular domain of CD28). In some embodiments, the PD-1-CD28-IL-15Rα fusion comprises the sequence of SEQ ID NO: 1254. In some embodiments, the vector further contains a sequence encoding a PD-1-CD28 fusion protein. The fusion protein can have the transmembrane domain of PD-1. In some embodiment, the PD-1-CD28 fusion protein comprises the sequence of SEQ ID NO: 1244. Circular RNA In some embodiments, TFP T cells are transduced with an RNA molecule. In some embodiments, the RNA is circular RNA. In some embodiments, the circular RNA is exogenous. In other embodiments, circular RNA is endogenous. In other embodiments, circular RNAs with an internal ribosomal entry site (IRES) can be translated in vitro or in vivo or ex vivo.

Circular RNAs are a class of single-stranded RNAs with a contiguous structure that have enhanced stability and a lack of end motifs necessary for interaction with various cellular proteins. Circular RNAs are 3-5' covalently closed RNA rings, and circular RNAs do not display Cap or poly(A) tails. Since circular RNAs lack the free ends necessary for exonuclease-mediated degradation, rendering them resistant to several mechanisms of RNA turnover and granting them extended lifespans as compared to their linear mRNA counterparts. For this reason, circularization may allow for the stabilization of mRNAs that generally suffer from short half-lives and may therefore improve the overall efficacy of mRNA in a variety of applications. Circular RNAs are produced by the process of splicing, and circularization occurs using conventional splice sites mostly at annotated exon boundaries (Starke et al., 2015; Szabo et al., 2015). For circularization, splice sites are used in reverse: downstream splice donors are "backspliced" to upstream splice acceptors (see Jeck and Sharpless, 2014; Barrett and Salzman, 2016; Szabo and Salzman, 2016; Holdt et al., 2018 for review).

To generate circular RNAs that we could subsequently transfer into cells, in vitro production of circular RNAs with autocatalytic-splicing introns can be programmed. A method for generating circular RNA can involve in vitro transcription (IVT) of a precursor linear RNA template with specially designed primers. Three general strategies have been reported so far for RNA circularization: chemical methods using cyanogen bromide or a similar condensing agent, enzymatic methods using RNA or DNA ligases, and ribozymatic methods using self-splicing introns. In preferred embodiments, precursor RNA was synthesized by run-off transcription and then heated in the presence of magnesium ions and GTP to promote circularization. RNA so produced can efficiently transfect different kinds of cells. In one aspect, the template includes sequences for the TFP, CAR, and TCR, or combination thereof.

The group I intron of phage T4 thymidylate synthase (td) gene is well characterized to circularize while the exons linearly splice together (Chandry and Bel-fort, 1987; Ford and Ares, 1994; Perriman and Ares, 1998). When the td intron order is permuted flanking any exon sequence, the exon is circularized via two autocatalytic transesterification reactions (Ford and Ares, 1994; Puttaraju and Been, 1995). In preferred embodiments, the group I intron of phage T4 thymidylate synthase (td) gene is used to generate exogenous circular RNA.

In some exemplary embodiments, a ribozymatic method utilizing a permuted group I catalytic intron has been used since it is more applicable to long RNA circularization and requires only the addition of GTP and $Mg^{2+}$ as cofactors. This permuted intron-exon (PIE) splicing strategy consists of fused partial exons flanked by half-intron sequences. In vitro, these constructs undergo the double transesterification reactions characteristic of group I catalytic introns, but because the exons are fused, they are excised as covalently 5' to 3' linked circles.

In one aspect, disclosed herein is a sequence containing a full-length encephalomyocarditis virus (such as EMCV) IRES, a gene encoding a TFP, a CAR, a TCR or combination thereof, two short regions corresponding to exon fragments (E1 and E2), and of the PIE construct between the 3' and 5' introns of the permuted group I catalytic intron in the thymidylate synthase (Td) gene of the T4 phage or the permuted group I catalytic intron in the pre-tRNA gene of *Anabaena*. In more preferred embodiments, the mentioned sequence further comprises complementary 'homology arms' placed at the 5' and 3' ends of the precursor RNA with the aim of bringing the 5' and 3' splice sites into proximity of one another. To ensure that the major splicing product was circular, the splicing reaction can be treated with RNase R.

In one aspect, the anti-CD70 TFP is encoded by a circular RNA. In one aspect the circular RNA encoding the anti-CD70 TFP is introduced into a T cell for production of a TFP-T cell. In one embodiment, the in vitro transcribed RNA TFP can be introduced to a cell as a form of transient transfection.

In some aspects, linear precursor RNA is produced by in vitro transcription using a polymerase chain reaction (PCR)-generated template as is described herein.

For additional information on TFP T cells produced by the methods above, see Provisional Application Ser. No. 62/836,977, which is herein incorporated by reference.

Modified T Cells

Disclosed herein are modified T cells comprising the sequence encoding the TFP of the nucleic acid disclosed herein or a TFP encoded by the sequence of the nucleic acid disclosed herein. Further disclosed herein, in some embodiments, are modified allogenic T cells comprising the sequence encoding the TFP disclosed herein or a TFP encoded by the sequence of the nucleic acid disclosed herein.

In some embodiments, the modified T cells comprising the recombinant nucleic acid disclosed herein, or the vectors disclosed herein comprises a functional disruption of an endogenous TCR. Further disclosed herein, in some embodiments, are modified allogenic T cells comprising the sequence encoding the TFP disclosed herein or a TFP encoded by the sequence of the nucleic acid disclosed herein.

In some instances, the T cell further comprises a heterologous sequence encoding a TCR constant domain, wherein the TCR constant domain is a TCR alpha constant domain, a TCR beta constant domain or a TCR alpha constant domain and a TCR beta constant domain. In some instances, the endogenous TCR that is functionally disrupted is an endogenous TCR alpha chain, an endogenous TCR beta chain, or an endogenous TCR alpha chain and an endogenous TCR beta chain. In some instances, the T cell further comprises a heterologous sequence encoding a TCR constant domain, wherein the TCR constant domain is a TCR gamma constant domain, a TCR delta constant domain or a TCR gamma constant domain and a TCR delta constant domain. In some instances, the endogenous TCR that is functionally disrupted is an endogenous TCR gamma chain, an endogenous TCR delta chain, or an endogenous TCR gamma chain and an endogenous TCR delta chain. In some instances, the endogenous TCR that is functionally disrupted has reduced binding to MHC-peptide complex compared to that of an unmodified control T cell. In some instances, the functional disruption is a disruption of a gene encoding the endogenous TCR. In some instances, the disruption of a gene encoding the endogenous TCR is a removal of a sequence of the gene encoding the endogenous TCR from the genome of a T cell. In some instances, the T cell is a human T cell. In some instances, the T cell is a CD8+ or CD4+ T cell. In some instances, the T cell is an allogenic T cell. In some instances, the T cell is a TCR alpha-beta T cell. In some instances, the T cell is a TCR gamma-delta T cell. In some instances, one or more of TCR alpha, TCR beta, TCR gamma, and TCR delta have been modified to produce an allogeneic T cell. See, e.g., copending PCT Publication No. WO2019173693, which is herein incorporated by reference.

In some embodiments, the modified T cells are γδT cells and do not comprise a functional disruption of an endogenous TCR. In some embodiments, the γδT cells are Vδ1+Vδ2−γδ T cells. In some embodiments, the γδ T cells are Vδ1−Vδ2+γδ T cells. In some embodiments, the γδT cells are Vδ1−Vδ2−γδ T cells.

In some instances, the modified T cells further comprise a nucleic acid encoding an inhibitory molecule that comprises a first polypeptide comprising at least a portion of an inhibitory molecule, associated with a second polypeptide comprising a positive signal from an intracellular signaling domain. In some instances, the inhibitory molecule comprises the first polypeptide comprising at least a portion of PD1 and the second polypeptide comprising a costimulatory domain and primary signaling domain.

In some embodiments, disclosed herein are cells comprising the recombinant nucleic acid disclosed herein, the polypeptide disclosed herein, or the vectors disclosed herein wherein cells comprising the sequence encoding TFP disclosed herein, IL-15 polypeptide or a fragment disclosed herein, and/or IL-15Rα polypeptide or a fragment disclosed herein. In some embodiments, the IL-15 polypeptide or a fragment thereof is secreted when expressed in a cell. For example, cells disclosed herein may secrete IL-15 polypeptide expressed from the recombinant nucleic acid molecules disclosed herein in response to a cell activation agent. In some embodiments, IL-15 signaling is increased in response to a cell activation agent. In some embodiment, the cell activation agent comprises a T cell activation agent. A T cell activation agent, as described herein, may include, but is not limited to, an anti-CD3 antibody or a fragment thereof, an anti-CD28 antibody or a fragment thereof, a cytokine, an antigen that binds the antigen binding domain of the TFP described herein, or any combinations thereof.

Disclosed herein, in some embodiments, are cells comprising the sequence encoding TFP disclosed herein, IL-15 polypeptide or a fragment disclosed herein, and/or IL-15Rα polypeptide or a fragment disclosed herein may have enhanced survival rate, enhanced effector function, and/or enhanced cytotoxicity compared to cells that do not comprise the sequence encoding TFP disclosed herein, IL-15 polypeptide or a fragment disclosed herein, and/or IL-15Rα polypeptide or a fragment disclosed herein. In some embodiments, the cell has enhanced survival rate compared to a cell that does not have IL-15 signaling. In some embodiments, the cell has enhanced survival rate compared to a cell that does not express the IL-15 polypeptide or a fragment thereof and/or IL-15Rα polypeptide or a fragment thereof. In some embodiments, the cell has enhanced effector function compared to a cell that does not have IL-15 signaling. In some embodiments, the cell has enhanced effector function compared to a cell that does not express the IL-15 polypeptide or a fragment thereof and/or IL-15Rα polypeptide or a fragment thereof. In some embodiments, the cell has enhanced cytotoxicity compared to a cell that does not have IL-15 signaling. In some embodiments, the cell has enhanced cytotoxicity compared to a cell that does not express the IL-15 polypeptide or a fragment thereof and/or IL-15Rα polypeptide or a fragment thereof.

Disclosed herein, in some embodiments, are cells comprising the sequence encoding TFP disclosed herein, IL-15 polypeptide or a fragment disclosed herein, and/or IL-15Rα polypeptide or a fragment disclosed herein may have increased longevity compared to cells that do not comprise the sequence encoding TFP disclosed herein, IL-15 polypeptide or a fragment disclosed herein, and/or IL-15Rα polypeptide or a fragment disclosed herein. In some embodiments, the longevity of the cell is increased compared to a cell that does not comprise (i) a nucleic acid sequence encoding an interleukin-15 (IL-15) polypeptide or a fragment thereof or (ii) a nucleic acid sequence encoding an interleukin-15 receptor alpha (IL-15Rα) polypeptide or a fragment thereof.

Disclosed herein, in some embodiments, are cells comprising the sequence encoding TFP disclosed herein, IL-15 polypeptide or a fragment disclosed herein, and/or IL-15Rα polypeptide or a fragment disclosed herein may have increased persistence compared to cells that do not comprise the sequence encoding TFP disclosed herein, IL-15 polypeptide or a fragment disclosed herein, and/or IL-15Rα polypeptide or a fragment disclosed herein. In some embodiments, the persistence of the cell is increased compared to a cell that does not comprise (i) a nucleic acid sequence encoding an interleukin-15 (IL-15) polypeptide or a fragment thereof or (ii) a nucleic acid sequence encoding an interleukin-15 receptor alpha (IL-15Rα) polypeptide or a fragment thereof.

Disclosed herein, in some embodiments, are cells comprising the sequence encoding TFP disclosed herein, IL-15 polypeptide or a fragment disclosed herein, and/or IL-15Rα polypeptide or a fragment disclosed herein may have increased cytotoxicity compared to cells that do not comprise the sequence encoding TFP disclosed herein, IL-15 polypeptide or a fragment disclosed herein, and/or IL-15Rα polypeptide or a fragment disclosed herein. In some embodiments, the cytotoxicity of the cell is increased compared to a cell that does not comprise (i) a nucleic acid sequence encoding an interleukin-15 (IL-15) polypeptide or a fragment thereof or (ii) a nucleic acid sequence encoding an interleukin-15 receptor alpha (IL-15Rα) polypeptide or a fragment thereof.

Disclosed herein, in some embodiments, are cells comprising the sequence encoding TFP disclosed herein, IL-15 polypeptide or a fragment disclosed herein, and/or IL-15Rα polypeptide or a fragment disclosed herein may have increased cytokine production compared to cells that do not comprise the sequence encoding TFP disclosed herein, IL-15 polypeptide or a fragment disclosed herein, and/or IL-15Rα polypeptide or a fragment disclosed herein. In some embodiments, the cytokine production of the cell is increased compared to a cell that does not comprise (i) a nucleic acid sequence encoding an interleukin-15 (IL-15) polypeptide or a fragment thereof or (ii) a nucleic acid sequence encoding an interleukin-15 receptor alpha (IL-15Rα) polypeptide or a fragment thereof.

In some embodiments, cells disclosed herein retains naïve and/or central memory phenotypes. In some embodiments, cells disclosed herein have not differentiated into terminal effector cells.

Disclosed herein, in some embodiments, is a population of cells comprising any of the cell described herein. Disclosed herein, in some embodiments, is a population of cells comprising any of the cell described herein, wherein the population of cells has an increased proportion of cells having a central memory phenotype relative to a population of cells that do not comprise the sequence encoding TFP disclosed herein, IL-15 polypeptide or a fragment disclosed herein, and/or IL-15Rα polypeptide or a fragment disclosed herein. In some embodiments, the population of cells has an increased proportion of cells having a central memory phenotype relative to a population of cells that do not comprise (i) a nucleic acid sequence encoding an interleukin-15 (IL-15) polypeptide or a fragment thereof or (ii) a nucleic acid sequence encoding interleukin-15 receptor alpha (IL-15Rα) polypeptide or a fragment thereof.

Disclosed herein, in some embodiments, is population of cells comprising any of the cell described herein, wherein the population of cells has an increased proportion of cells having a naïve phenotype relative to a population of cells that do not comprise the sequence encoding TFP disclosed herein, IL-15 polypeptide or a fragment disclosed herein, and/or IL-15Rα polypeptide or a fragment disclosed herein. In some embodiments, the population of cells has an increased proportion of cells having a naïve phenotype relative to a population of cells that do not comprise (i) a nucleic acid sequence encoding an interleukin-15 (IL-15) polypeptide or a fragment thereof or (ii) a nucleic acid sequence encoding an interleukin-15 receptor alpha (IL-15Rα) polypeptide or a fragment thereof.

Disclosed herein, in some embodiments, is population of cells comprising any of the cell described herein, wherein the population of cells has a reduced proportion of cells having a terminal effector phenotype relative to a population of cells that do not comprise the sequence encoding TFP disclosed herein, IL-15 polypeptide or a fragment disclosed herein, and/or IL-15Rα polypeptide or a fragment disclosed herein. In some embodiments, the population of cells has a reduced proportion of cells having a terminal effector phenotype relative to a population of cells that do not comprise (i) a nucleic acid sequence encoding an interleukin-15 (IL-15) polypeptide or a fragment thereof or (ii) a nucleic acid sequence encoding an interleukin-15 receptor alpha (IL-15Rα) polypeptide or a fragment thereof.

Sources of T Cells

Prior to expansion and genetic modification, a source of T cells is obtained from a subject. The term "subject" is intended to include living organisms in which an immune response can be elicited (e.g., mammals). Examples of subjects include humans, dogs, cats, mice, rats, and transgenic species thereof. T cells can be obtained from a number of sources, including peripheral blood mononuclear cells (PBMCs), bone marrow, lymph node tissue, cord blood, thymus tissue, tissue from a site of infection, ascites, pleural effusion, spleen tissue, and tumors. In some embodiments, T cells can be obtained from a leukopak. In certain aspects of the present disclosure, any number of T cell lines available in the art, may be used. In certain aspects of the present disclosure, T cells can be obtained from a unit of blood collected from a subject using any number of techniques known to the skilled artisan, such as Ficoll™ separation. In one preferred aspect, cells from the circulating blood of an individual are obtained by apheresis. The apheresis product typically contains lymphocytes, including T cells, monocytes, granulocytes, B cells, other nucleated white blood cells, red blood cells, and platelets. In one aspect, the cells collected by apheresis may be washed to remove the plasma fraction and to place the cells in an appropriate buffer or media for subsequent processing steps. In one aspect of the present disclosure, the cells are washed with phosphate buffered saline (PBS). In an alternative aspect, the wash solution lacks calcium and may lack magnesium or may lack many if not all divalent cations. Initial activation steps in the absence of calcium can lead to magnified activation. As those of ordinary skill in the art would readily appreciate a washing step may be accomplished by methods known to those in the art, such as by using a semi-automated "flow-through" centrifuge (for example, the Cobe® 2991 cell processor, the Baxter OncologyCytoMate, or the Haemonetics® Cell Saver® 5) according to the manufacturer's instructions. After washing, the cells may be resuspended in a variety of biocompatible buffers, such as, for example, Ca-free, Mg-free PBS, PlasmaLyte A, or other saline solution with or without buffer. Alternatively, the undesirable components of the apheresis sample may be removed, and the cells directly resuspended in culture media.

In embodiments, the T cells are αβ T cells. In some embodiments, the T cells are γδ T cells. γδ T cells are obtained from a bank of umbilical cord blood, peripheral blood, human embryonic stem cells, or induced pluripotent stem cells, for example.

In one aspect, T cells are isolated from peripheral blood lymphocytes by lysing the red blood cells and depleting the monocytes, for example, by centrifugation through a PERCOLL® gradient or by counterflow centrifugal elutriation. A specific subpopulation of T cells, such as CD3+, CD28+, CD4+, CD8+, CD45RA+, CD45RO+, alpha-beta, or gamma-delta T cells, can be further isolated by positive or negative selection techniques. For example, in one aspect, CD4+ and CD8+ T cells are isolated with anti-CD4 and anti-CD8 microbeads. In another aspect, T cells are isolated by incubation with anti-CD3/anti-CD28 (e.g., 3×28)-conjugated beads, such as DYNABEADS® M-450 CD3/CD28 T or Trans-Act® beads, for a time period sufficient for positive selection of the desired T cells. In one aspect, the time period is about 30 minutes. In a further aspect, the time period ranges from 30 minutes to 36 hours or longer and all integer values there between. In a further aspect, the time period is at least 1, 2, 3, 4, 5, or 6 hours. In yet another preferred aspect, the time period is 10 to 24 hours. In one aspect, the incubation time period is 24 hours. Longer incubation times may be used to isolate T cells in any situation where there are few T cells as compared to other cell types, such in isolating tumor infiltrating lymphocytes (TIL) from tumor tissue or from immunocompromised individuals. Further, use of longer incubation times can increase the efficiency of capture of CD8+ T cells. Thus, by simply shortening or lengthening the time T cells are allowed to bind to the CD3/CD28 beads and/or by increasing or decreasing the ratio of beads to T cells (as described further herein), subpopulations of T cells can be preferentially selected for or against at culture initiation or at other time points during the process. Additionally, by increasing or decreasing the ratio of anti-CD3 and/or anti-CD28 antibodies on the beads or other surface, subpopulations of T cells can be preferentially selected for or against at culture initiation or at other desired time points. The skilled artisan would recognize that multiple rounds of selection can also be used in the context of this present disclosure. In certain aspects, it may be desirable to perform the selection procedure and use the "unselected" cells in the activation and expansion process. "Unselected" cells can also be subjected to further rounds of selection.

Enrichment of a T cell population by negative selection can be accomplished with a combination of antibodies directed to surface markers unique to the negatively selected cells. One method is cell sorting and/or selection via negative magnetic immunoadherence or flow cytometry that uses a cocktail of monoclonal antibodies directed to cell surface markers present on the cells negatively selected. For example, to enrich for CD4+ cells by negative selection, a monoclonal antibody cocktail typically includes antibodies to CD14, CD20, CD11b, CD16, HLA-DR, and CD8. In certain aspects, it may be desirable to enrich for or positively select for regulatory T cells which typically express CD4+, CD25+, CD62Lhi, GITR+, and FoxP3+. Alternatively, in certain aspects, T regulatory cells are depleted by anti-C25 conjugated beads or other similar method of selection.

In one embodiment, a T cell population can be selected that expresses one or more of IFN-γ TNF-alpha, IL-17A, IL-2, IL-3, IL-4, GM-CSF, IL-10, IL-13, granzyme B, and perforin, or other appropriate molecules, e.g., other cytokines. Methods for screening for cell expression can be determined, e.g., by the methods described in PCT Publication No. WO2013126712, which is herein incorporated by reference.

For isolation of a desired population of cells by positive or negative selection, the concentration of cells and surface (e.g., particles such as beads) can be varied. In certain aspects, it may be desirable to significantly decrease the volume in which beads and cells are mixed together (e.g., increase the concentration of cells), to ensure maximum contact of cells and beads. For example, in one aspect, a concentration of 2 billion cells/mL is used. In one aspect, a concentration of 1 billion cells/mL is used. In a further aspect, greater than 100 million cells/mL is used. In a further aspect, a concentration of cells of 10, 15, 20, 25, 30, 35, 40, 45, or 50 million cells/mL is used. In yet one aspect, a concentration of cells from 75, 80, 85, 90, 95, or 100 million cells/mL is used. In further aspects, concentrations of 125 or 150 million cells/mL can be used. Using high concentrations can result in increased cell yield, cell activation, and cell expansion. Further, use of high cell concentrations allows more efficient capture of cells that may weakly express target antigens of interest, such as CD28-negative T cells, or from samples where there are many tumor cells present (e.g., leukemic blood, tumor tissue, etc.). Such populations of cells may have therapeutic value and would be desirable to obtain. For example, using high concentration of cells allows more efficient selection of CD8+ T cells that normally have weaker CD28 expression.

In a related aspect, it may be desirable to use lower concentrations of cells. By significantly diluting the mixture of T cells and surface (e.g., particles such as beads), interactions between the particles and cells is minimized. This selects for cells that express high amounts of desired antigens to be bound to the particles. For example, CD4+ T cells express higher levels of CD28 and are more efficiently captured than CD8+ T cells in dilute concentrations. In one aspect, the concentration of cells used is $5\times10^6$/mL. In other aspects, the concentration used can be from about $1\times10^5$/mL to $1\times10^6$/mL, and any integer value in between. In other aspects, the cells may be incubated on a rotator for varying lengths of time at varying speeds at either 2-10° C. or at room temperature.

T cells for stimulation can also be frozen after a washing step. Wishing not to be bound by theory, the freeze and subsequent thaw step provides a more uniform product by removing granulocytes and to some extent monocytes in the cell population. After the washing step that removes plasma and platelets, the cells may be suspended in a freezing solution. While many freezing solutions and parameters are known in the art and will be useful in this context, one method involves using PBS containing 20% DMSO and 8% human serum albumin, or culture media containing 10% Dextran 40 and 5% Dextrose, 20% Human Serum Albumin and 7.5% DMSO, or 31.25% Plasmalyte-A, 31.25% Dextrose 5%, 0.45% NaCl, 10% Dextran 40 and 5% Dextrose, 20% Human Serum Albumin, and 7.5% DMSO or other suitable cell freezing media containing for example, Hespan and PlasmaLyte A, the cells then are frozen to −80° C. at a rate of 1 per minute and stored in the vapor phase of a liquid nitrogen storage tank. Other methods of controlled freezing may be used as well as uncontrolled freezing immediately at −20° C. or in liquid nitrogen. In certain aspects, cryopreserved cells are thawed and washed as described herein and allowed to rest for one hour at room temperature prior to activation using the methods of the present disclosure.

Also contemplated in the context of the present disclosure is the collection of blood samples or apheresis product from a subject at a time period prior to when the expanded cells as described herein might be needed. As such, the source of the cells to be expanded can be collected at any time point necessary, and desired cells, such as T cells, isolated and frozen for later use in T cell therapy for any number of diseases or conditions that would benefit from T cell therapy, such as those described herein. In one aspect a blood sample or an apheresis is taken from a generally healthy subject. In certain aspects, a blood sample or an apheresis is taken from a generally healthy subject who is at risk of developing a disease, but who has not yet developed a disease, and the cells of interest are isolated and frozen for later use. In certain aspects, the T cells may be expanded, frozen, and used at a later time. In certain aspects, samples are collected from a patient shortly after diagnosis of a particular disease as described herein but prior to any treatments. In a further aspect, the cells are isolated from a blood sample or an apheresis from a subject prior to any number of relevant treatment modalities, including but not limited to treatment with agents such as natalizumab, efalizumab, antiviral agents, chemotherapy, radiation, immunosuppressive agents such as cyclosporin, azathioprine, methotrexate, and mycophenolate, antibodies, or other immunoablative agents such as alemtuzumab, anti-CD3 antibodies, cytoxan, fludarabine, cyclosporin, tacrolimus, rapamycin, mycophenolic acid, steroids, romidepsin, and irradiation.

In a further aspect of the present disclosure, T cells are obtained from a patient directly following treatment that leaves the subject with functional T cells. In this regard, it has been observed that following certain cancer treatments, in particular treatments with drugs that damage the immune system, shortly after treatment during the period when patients would normally be recovering from the treatment, the quality of T cells obtained may be optimal or improved for their ability to expand ex vivo. Likewise, following ex vivo manipulation using the methods described herein, these cells may be in a preferred state for enhanced engraftment and in vivo expansion. Thus, it is contemplated within the context of the present disclosure to collect blood cells, including T cells, dendritic cells, or other cells of the hematopoietic lineage, during this recovery phase. Further, in certain aspects, mobilization (for example, mobilization with GM-CSF) and conditioning regimens can be used to create a condition in a subject wherein repopulation, recirculation, regeneration, and/or expansion of particular cell types is favored, especially during a defined window of time following therapy. Illustrative cell types include T cells, B cells, dendritic cells, and other cells of the immune system.

Activation and Expansion of T Cells

T cells may be activated and expanded generally using methods as described, for example, in U.S. Pat. Nos. 6,352,694; 6,534,055; 6,905,680; 6,692,964; 5,858,358; 6,887,466; 6,905,681; 7,144,575; 7,067,318; 7,172,869; 7,232,566; 7,175,843; 5,883,223; 6,905,874; 6,797,514; 6,867,041, and 7,572,631.

Generally, the T cells of the present disclosure may be expanded by contact with a surface having attached thereto an agent that stimulates a CD3/TCR complex associated signal and a ligand that stimulates a costimulatory molecule on the surface of the T cells. In particular, T cell populations may be stimulated as described herein, such as by contact with an anti-CD3 antibody, or antigen-binding fragment thereof, or an anti-CD2 antibody immobilized on a surface, or by contact with a protein kinase C activator (e.g., bryostatin) in conjunction with a calcium ionophore. For co-stimulation of an accessory molecule on the surface of the T cells, a ligand that binds the accessory molecule is used. For example, a population of T cells can be contacted with an anti-CD3 antibody and an anti-CD28 antibody, under conditions appropriate for stimulating proliferation of the T cells. To stimulate proliferation of either CD4+ T cells, CD8+ T cells, or CD4+ CD8+ T cells, an anti-CD3 antibody and an anti-CD28 antibody. Examples of an anti-CD28 antibody include 9.3, B-T3, XR-CD28 (Diaclone, Besancon, France) can be used as can other methods commonly known in the art (Berg et al., *Transplant Proc.* 30(8):3975-3977, 1998; Haanen et al., *J. Exp. Med.* 190(9):13191328, 1999; Garland et al., *J. Immunol. Meth.* 227(1-2):53-63, 1999). In some embodiments, T cells are activated by incubation with anti-CD3/anti-CD28-conjugated beads, such as DYNABEADS® or Trans-Act® beads, for a time period sufficient for activation of the T cells. In one aspect, the time period is at least 1, 2, 3, 4, 5, or 6 hours. In yet another preferred aspect, the time period is 10 to 24 hours, e.g., 24 hours. In some embodiments, T cells are activated by stimulation with an anti-CD3 antibody and an anti-CD28 antibody in combination with cytokines that bind the common gamma-chain (e.g., IL-2, IL-7, IL-12, IL-15, IL-21, and others). In some embodiments, T cells are activated by stimulation with an anti-CD3 antibody and an anti-CD28 antibody in combination with 10, 20, 30, 40, 50, 60, 70, 80, 90, 100, 200, 300, 400, 500, 600, 700, 800, 900, or 100 U/mL of IL-2, IL-7, and/or IL-15. In some embodiments, the cells are activated for 24 hours. In some embodiments, after transduction, the cells are expanded in the presence of anti-CD3 antibody, anti-CD28 antibody in combination with the same cytokines. In some embodiments, cells activated in the presence of an anti-CD3 antibody and an anti-CD28 antibody in combination with cytokines that bind the common gamma-chain are expanded in the presence of the same cytokines in the absence of the anti-CD3 antibody and anti-CD28 antibody after transduction. In some embodiments, after transduction, the cells are expanded in the presence of anti-CD3 antibody, anti-CD28 antibody in combination with the same cytokines up to a first washing step, when the cells are sub-cultured in media that includes the cytokines but does not include the anti-CD3 antibody and anti-CD28 antibody. In some embodiments, the cells are subcultured every 1, 2, 3, 4, 5, or 6 days. In some embodiments, cells are expanded for 4, 5, 6, 7, 8, 9, 10, 11, 12, 13, 14, 15, 16, 17, 18, 19, 20, 21, 22, 23, 24, 25, 26, 27, 28, 29, or 30 days.

The expansion of T cells may be stimulated with zoledronic acid (Zometa), alendronic acid (Fosamax) or other related bisphosphonate drugs at concentrations of 0.1, 0.25, 0.5, 1.0, 2.0, 3.0, 4.0, 5.0, 7.5, 10, or 100 μM in the presence of feeder cells (irradiated cancer cells, PBMCs, artificial antigen presenting cells). The expansion of T cells may be stimulated with isopentyl pyrophosphate (IPP), (E)-4-Hydroxy-3-methyl-but-2-enyl pyrophosphate (HMBPP or HMB-PP) or other structurally related compounds at concentrations of 0.1, 0.25, 0.5, 1.0, 2.0, 3.0, 4.0, 5.0, 7.5, 10, or 100 μM in the presence of feeder cells (irradiated cancer cells, PBMCs, artificial antigen presenting cells). In some embodiments, the expansion of T cells may be stimulated with synthetic phosphoantigens (e.g., bromohydrin pyrophosphate; BrHPP), 2M3B1 PP, or 2-methyl-3-butenyl-1-pyrophosphate in the presence of IL-2 for one-to-two weeks. In some embodiments, the expansion of T cells may be stimulated with immobilized anti-TCRyd (e.g., pan TCRY6) in the presence of IL-2, e.g., for approximately 14 days. In some embodiments, the expansion of T cells may be stimulated with culture of immobilized anti-CD3 antibodies (e.g., OKT3) in the presence of IL-2. In some embodiments, the aforementioned culture is maintained for about seven days prior to subculture in soluble anti-CD3, and IL-2.

T cells that have been exposed to varied stimulation times may exhibit different characteristics. For example, typical blood or apheresed peripheral blood mononuclear cell products have a helper T cell population (TH, CD4+) that is greater than the cytotoxic or suppressor T cell population (TC, CD8+). Ex vivo expansion of T cells by stimulating CD3 and CD28 receptors produces a population of T cells that prior to about days 8-9 consists predominately of TH cells, while after about days 8-9, the population of T cells comprises an increasingly greater population of TC cells. Accordingly, depending on the purpose of treatment, infusing a subject with a T cell population comprising predominately of TH cells may be advantageous. Similarly, if an antigen-specific subset of TC cells has been isolated it may be beneficial to expand this subset to a greater degree.

Further, in addition to CD4 and CD8 markers, other phenotypic markers vary significantly, but in large part, reproducibly during the course of the cell expansion process. Thus, such reproducibility enables the ability to tailor an activated T cell product for specific purposes.

Once a TFP is constructed, various assays can be used to evaluate the activity of the molecule, such as but not limited to, the ability of T cells to activate and expand stimulation, and anti-cancer activities in appropriate in vitro and animal models. Assays to evaluate the effects of a TFP are described in further detail below.

Preventing Fratricide of CD70-TFP Expressing T-Cells

Given that CD70 is expressed by T cells, one possible effect of expressing anti-CD70 TFPs may be the killing of other T cells, e.g., anti-CD70 TFP-expressing T cells, during the production process, i.e., fratricide. The present disclosure encompasses a method of reducing or preventing fratricide of T-cells expressing a T cell receptor (TCR) fusion protein (TFP) comprising an antigen binding domain that specifically binds to CD70 (CD70-TFP). In some embodiments, preventing fratricide of CD70-TFP expressing T-cells comprises masking or blocking CD70 on T-cells with a CD70 disrupting agent e.g., an anti-CD70 antibody, prior to or shortly after expressing CD70-TFP. In some embodiments, CD70 can be masked with a CD70 antibody, with a CD27 antibody, or with soluble CD27. In some embodiments, preventing fratricide of CD70-TFP expressing T-cells comprises reducing CD70 levels at the cell surface, e.g., by knocking down the CD70 gene at its locus, inhibiting or reducing transcription, inhibiting or reducing translation, targeting the CD70 protein for degradation.

In many embodiments, the anti-CD70 antibody or fragment thereof may comprise a murine antibody or binding fragment thereof, a human antibody or binding fragment thereof, or a humanized antibody or binding fragment thereof, a monoclonal antibody, a polyclonal antibody, a recombinant antibody, and a binding or functional fragment thereof, including but not limited to a single-domain antibody such as a VH, a VL, and a VHH of a camelid derived nanobody. In many embodiments, the anti-CD70 antibody or fragment thereof may also comprise a single chain fragment, such as a scFv or a sdAb. In some embodiments, the sdAb is a VHH. In other embodiments, the anti-CD70 antibody or fragment thereof may comprise a Fv, a Fab, a (Fab')2, or a bifunctional (e.g., bispecific) hybrid antibody. In some embodiments, the antibody comprises any of the anti-CD70 antibodies described herein. In some embodiments, the anti-CD70 antibody comprises any of the antibodies disclosed in Tables 1-4. In some embodiments, the antibody comprises the 70-001 VHH antibody described herein. In some embodiments, the antibody comprises the C10 antibody described herein. Non-limiting examples of anti-CD70 antibodies include cusatuzumab (ARGX-110), vorsetuzumab, MDX-1411, and the novel anti-CD70 antibodies described herein.

Prevention of fratricide can also be achieved by combining a cell or a population of cells with an agent that binds CD27. An agent that binds to CD27 could block CD27 on the same cell or a neighboring cell. In some embodiments, the anti-CD27 antibody or fragment thereof is provided exogenously to the cell and is bound to CD27 on the cell surface. In some embodiments, the exogenous anti-CD27 antibody or fragment thereof is provided during expansion of the cell in vitro.

In many embodiments, the anti-CD27 antibody or fragment thereof may comprise a murine antibody or binding fragment thereof, a human antibody or binding fragment thereof, or a humanized antibody or binding fragment thereof, a monoclonal antibody, a polyclonal antibody, a recombinant antibody, and a binding or functional fragment thereof, including but not limited to a single-domain antibody such as a $V_H$, a $V_L$, and a $V_{HH}$ of a camelid derived nanobody. In many embodiments, the anti-CD27 antibody or fragment thereof may also comprise a single chain fragment, such as a scFv or a sdAb. In some embodiments, the sdAb is a $V_{HH}$. In other embodiments, the anti-CD27 antibody or fragment thereof may comprise a Fv, a Fab, a $(Fab')_2$, or a bifunctional (e.g., bispecific) hybrid antibody.

Precention of fratricide can also be achieved by combining a cell or a population of cells with soluble CD27. In some embodiments, the soluble CD27 is provided exogenously to the cell and is bound to CD70 on the cell surface. In some embodiments, the exogenous soluble CD27 is provided during expansion of the cell in vitro. Providing soluble CD27 is believed to compete with native CD27 for binding to CD70.

In some aspects, provided herein, is a method of producing a cell (e.g., a T-cell) comprising an anti-CD70 TFP described herein or a recombinant nucleic acid molecule encoding the CD70-TFP described herein. In some embodiments, the method comprises (i) transducing a cell with the recombinant nucleic acid or the vector encoding CD70-TFP described herein; and (ii) contacting the cell with a CD70 disrupting agent that binds to CD70 on the cell surface (e.g., a CD70 disrupting agent, e.g., an anti-CD70 antibody, an anti-CD27 antibody, or soluble CD27). In some embodiments, the anti-CD70 antibody is the antibody or antigen binding fragment encoded by the recombinant nucleic acid described herein. In some embodiments, the anti-CD70 antibody has greater affinity for CD70 than the antibody or antigen binding fragment encoded by the recombinant nucleic acid described herein. In some embodiments, the cell is a T cell, e.g., human T cell. In some embodiments, the cell is a human a CD8+ T-cell or a human CD4+ T-cell. In some embodiments, the cell is a human αρ T-cell or a human γδ T-cell. In some embodiments, the cell is a human NKT cell.

In some embodiments, the contacting occurs prior to the transducing. In some embodiments, the contacting occurs up to 1 day prior to the transducing, for example, 1, 2, 3, 4, 5, 6, 7, 8, 9, 10, 11, 12, 13, 14, 15, 16, 17, 18, 19, 20, 21, 22, 23, or 24 hours prior to the transducing. In some embodiments, the contacting occurs after the transducing. In some embodiments, the contacting occurs up to 5 days after the transducing. In some embodiments, the contacting occurs 1, 2, 3, 4, 5, 6, 7, 8, 9, 10, 11, 12, 13, 14, 15, 16, 17, 18, 19, 20, 21, 22, 23, or 24 hours after the transducing. In some embodiments, the contacting occurs 1.0 day, 1.5 days, 2.0 days, 2.5 days, 3.0 days, 3.5 days, 4.0 days, 4.5 days, or 5.0 days after the transducing. In some embodiments, the method further comprises sub-culturing the cells in media that does not comprise the CD70 disrupting agent CD70 (e.g., the anti-CD70 antibody, the anti-CD27 antibody, or soluble CD27). In some embodiments, the sub-culturing the cells comprises sub-culturing the cells in media that does not comprise the CD70 disrupting agent CD70 4 or more days after the transducing, e.g., 7 days after transducing. In some embodiments, the sub-culturing comprises sub-culturing the cells in media that does not comprise the CD70 disrupting agent CD70 4.5 days, 5 days, 5.5 days, 6 days, or 6.5 days after the transducing. In some embodiments, the sub-culturing comprises sub-culturing the cells in media that does not comprise the CD70 disrupting agent CD70 7 days after the transducing.

In some embodiments, the activation and/or expansion of the cell occurs in the presence of an anti-CD3 antibody or fragment thereof, and/or an anti-CD28 antibody or fragment thereof. In some embodiments, the cell is expanded in the presence of the CD70 antibody or fragment thereof for 10 or more days. In some embodiments, cell is activated and/or expanded in the presence of one or more cytokines such as IL-2, IL-7, IL-15, and IL-21, as is described in further detail below. In some embodiments, the cell is expanded in the presence of the CD70 antibody or fragment thereof for 10 or more days. In some embodiments, the T cells are activated in the presence of the CD70 disrupting agent, e.g., a CD70 antibody or fragment thereof, prior to transduction. In some embodiments, the T cells are transduced in the presence of the CD70 disrupting agent, e.g., a CD70 antibody or fragment thereof. In some embodiments, the T cells are expanded in the presence of the CD70 disrupting agent, e.g., a CD70 antibody or fragment thereof. In some embodiments, the T cells are activated by stimulation with an anti-CD3 antibody and an anti-CD28 antibody in the presence of the CD70 disrupting agent, e.g., a CD70 antibody or fragment thereof, and optionally one or more cytokines that bind the common gamma-chain (e.g., IL-2, IL-7, IL-12, IL-15, IL-21, and others). In some embodiments, the T cells are activated by stimulation with an anti-CD3 antibody and an anti-CD28 antibody in the presence of the CD70 disrupting agent, e.g., a CD70 antibody or fragment thereof, and optionally one or more cytokines that bind the common gamma-chain (e.g., IL-2, IL-7, IL-12, IL-15, IL-21, and others), and are then expanded in the presence of the CD70 disrupting agent, e.g., a CD70 antibody or fragment thereof following transduction (e.g., with or without the anti-CD3/anti-CD28 antibodies and optional cytokines) for 1, 2, 3, 4, 5, 6, 7, 8, 9, or 10 or more days. In some embodiments, the T cells are activated by stimulation with an anti-CD3 antibody and an anti-CD28 antibody in the presence of the CD70 disrupting agent, e.g., a CD70 antibody or fragment thereof, and optionally one or more cytokines that bind the common gamma-chain (e.g., IL-2, IL-7, IL-12, IL-15, IL-21, and others), and are then expanded in the presence of the CD70 disrupting agent, e.g., a CD70 antibody or fragment thereof following transduction (e.g., with or without the anti-CD3/anti-CD 28 antibodies and optional cytokines) for 1, 2, 3, 4, 5, or more days, followed by a subsequent expansion in the absence of the CD70 disrupting agent, e.g., a CD70 antibody or fragment thereof.

In some embodiments, the T cells are activated by stimulation with an anti-CD3 antibody and an anti-CD28 antibody in the absence of the CD70 disrupting agent, e.g., a CD70 antibody or fragment thereof, and optionally one or more cytokines that bind the common gamma-chain (e.g., IL-2, IL-7, IL-12, IL-15, IL-21, and others), and are then expanded in the presence of the CD70 disrupting agent, e.g., a CD70 antibody or fragment thereof following transduction (e.g., with or without the anti-CD3/anti-CD28 antibodies and optional cytokines) for 1, 2, 3, 4, 5, 6, 7, 8, 9, or 10 or more days.

In some embodiments, the T cells are activated by stimulation with an anti-CD3 antibody and an anti-CD28 antibody in the absence of the CD70 disrupting agent, e.g., a CD70 antibody or fragment thereof, and optionally one or more cytokines that bind the common gamma-chain (e.g., IL-2, IL-7, IL-12, IL-15, IL-21, and others), and are then expanded in the presence of the CD70 disrupting agent, e.g., a CD70 antibody or fragment thereof following transduction (e.g., with or without the anti-CD3/anti-CD28 antibodies and optional cytokines) for 1, 2, 3, 4, or 5 or more days, followed by a subsequent expansion in the absence of the CD70 disrupting agent, e.g., a CD70 antibody or fragment thereof.

In some embodiments, the T cells are activated by stimulation with an anti-CD3 antibody and an anti-CD28 antibody in the absence of the CD70 disrupting agent, e.g., a CD70 antibody or fragment thereof, and optionally one or more cytokines that bind the common gamma-chain (e.g., IL-2, IL-7, IL-12, IL-15, IL-21, and others), and are then expanded in the absence of the CD70 disrupting agent, e.g., a CD70 antibody or fragment thereof following transduction (e.g., with or without the anti-CD3/anti-CD28 antibodies and optional cytokines) for 1, 2, 3, 4, or 5 or more days, followed by a subsequent expansion in the presence of the CD70 disrupting agent, e.g., a CD70 antibody or fragment thereof for 1, 2, 3, 4, or 5 or more days.

In some embodiments, the CD70 disrupting agent is a CD70 antibody, and the CD70 antibody is used at a concentration of 100 nM-100 uM in the methods described herein. In some embodiments, the CD70 antibody is used at a concentration of 1-50 uM, or 2-20 uM. In some embodiments, the CD70 antibody is used at a concentration of 1, 2, 3, 4, 5, 6, 7, 8, 9, 10, 11, 12, 13, 14, 15, 16, 17, 18, 19, or 20 mM.

Also contemplated herein are intracellular anti-CD70 fusion proteins and methods of use for preventing fratricide. In some embodiments, reducing or preventing fratricide of CD70-TFP expressing T-cells comprises reducing cell-surface expression of CD70 on T cells by sequestering CD70 inside the cells. In some embodiments, CD70 is sequestered inside the cells by expressing an intracellularly localized anti-CD70 antibody in the T cells, i.e., a fusion protein comprising a CD70 antibody domain and an intracellular localization domain. Any anti-CD70 antibodies known in the art can be used in the fusion protein. In some embodiments, the intracellular localization domain is an endoplasmic reticulum (ER) retention domain. These fasten the constructs to the ER/Golgi, preventing secretion or membrane expression of the targeted protein.

The ER retention domain may be any domain that retains CD70 within the ER or Golgi apparatus. The retention domain may be a target peptide. A target peptide is a short peptide chain of 3 to 70 amino acids that directs the transport of a protein to a specific region of the cell, such as the ER or the Golgi apparatus, and/or retains the protein in the specific region. A variety of target peptides are known in the art.

The retention domain is preferably a KDEL sequence (SEQ ID NO: 777), a KKXX motif, a KXKXX motif, a tail of adenoviral E19 protein having sequence KYKSRRSFIDEKKMP (SEQ ID NO: 778), or a fragment of HLA invariant chain having sequence MHRRRSRSCR (SEQ ID NO: 779). The retention domain is preferably C-terminal to the binding domain. The retention domain may be N-terminal to the binding domain.

KDEL is a target peptide sequence in the amino acid structure of a protein which prevents the protein from being secreted from the ER. A protein having a KDEL sequence will be retrieved from the Golgi apparatus by retrograde transport to the ER lumen. The KDEL sequence may also target proteins from other locations (such as the cytoplasm) to the ER. Proteins can only leave the ER after the KDEL sequence has been cleaved off. Thus, the protein resident in the ER will remain in the ER as long as it contains a KDEL sequence.

The ER retention domain may be a KKXX (Lys-Lys-xxx-xxx) motif. KKXX is a target peptide motif that is generally located in the C terminus of the amino acid structure of a protein. KKXX is responsible for retrieval of ER membrane proteins from the cis end of the Golgi apparatus by retrograde transport, via interaction with the coat protein (COPI) complex.

The retention domain may be a C-terminal cytoplasmic tail of a known ER protein, such as adenoviral E19 protein. For instance, the binding domain may be a tail of adenoviral E19 protein having sequence KYKSRRSFIDEKKMP (SEQ ID NO: 778). Alternatively, the binding domain may be an N-terminal fragment of the invariant chain of HLA, such as a fragment having sequence MHRRRSRSCR (SEQ ID NO: 779). In some embodiments, the ER retention comprises the sequence of any of SEQ ID NOs. 756-776.

```
Exemplary ER retention sequence
                                 (SEQ ID NO: 756)
AEKDEL

                                 (SEQ ID NO: 757)
EQKLISEEDLKDEL

                                 (SEQ ID NO: 758)
GGGGSGGGGSKDEL

                                 (SEQ ID NO: 759)
GGGGSGGGGSGGGGSGGGGSKDEL

                                 (SEQ ID NO: 760)
GGGGSGGGGSGGGGSGGGGSAEKDEL

                                 (SEQ ID NO: 761)
KYKSRRSFIEEKKMP

                                 (SEQ ID NO: 762)
LKYKSRRSFIEEKKMP

                                 (SEQ ID NO: 763)
LYKYKSRRSFIEEKKMP

                                 (SEQ ID NO: 764)
LYCKYKSRRSFIEEKKMP

                                 (SEQ ID NO: 765)
LYCNKYKSRRSFIEEKKMP

                                 (SEQ ID NO: 766)
LYKYKSRRSFIDEKKMP
```

-continued

```
                                 (SEQ ID NO: 767)
LYCNKYKSRRSFIDEKKMP

                                 (SEQ ID NO: 768)
LYEQKLISEEDLKYKSRRSFIEEKKMP

                                 (SEQ ID NO: 769)
LYCYPYDVPDYAKYKSRRSFIEEKKMP

                                 (SEQ ID NO: 770)
LYKKLETFKKTN

                                 (SEQ ID NO: 771)
LYEQKLISEEDLKKLETFKKTN

                                 (SEQ ID NO: 772)
LYYQRL

                                 (SEQ ID NO: 773)
LYEQKLISEEDLYQRL

                                 (SEQ ID NO: 774)
LYKRKIIAFALEGKRSKVTRRPKASDYQRL

                                 (SEQ ID NO: 775)
LYRNIKCD

                                 (SEQ ID NO: 776)
LYEQKLISEEDLRNIKCD
```

In some embodiments, the fusion protein further comprises a CD8 alpha transmembrane domain between the CD70 antibody domain and the ER retention domain.

Other suitable binding domains are known in the art. For instance, LocSigDB (http://genome.unmc.edu/LocSigDB/) is a database of experimental protein localization signals for eight distinct subcellular locations (Negi et al., LocSigDB: a database of protein localization signals, Database (Oxford), 2015, 1-7). Furthermore, known methods may be used to identify further binding domains that retains the one or more components of the CD70 complex within the ER or Golgi apparatus (see, for example, Bejarano and Gonzalez, Motif Trap: a rapid method to clone motifs that can target proteins to defined subcellular localizations, Journal of Cell Science, 112, 4207-4211 (1999)).

The molecule may comprise two or more, such as three or more, four or more, five or more retention domains. In this case, two or more of the retention domains may be the same. Two or more of the retention domains may be different.

In some embodiments, expressing an intracellularly localized anti-CD70 antibody in the T cells comprises transducing the T cells with a nucleic acid sequence encoding the fusion protein. In some embodiments, the nucleic acid sequence encoding the fusion protein comprises a CD70 antibody domain and an intracellular localization domain comprises, e.g., an ER retention domain. In some embodiments, the sequence further comprises a sequence encoding a CD8 alpha transmembrane domain between the CD70 antibody domain and the ER retention domain. In some embodiments, the nucleic acid sequence further comprises a signal peptide, e.g., a CD8 alpha signal peptide 5' to the sequence encoding the anti-CD70 antibody domain.

In some embodiments, reducing or preventing fratricide of CD70-TFP expressing T-cells comprises transducing the recombinant nucleic acid encoding the anti-CD70 TFP described herein, e.g., a vector comprising recombinant nucleic acid encoding the anti-CD70 TFP described herein, into a T cell having a nucleic acid sequence encoding a fusion protein comprising a CD70 antibody domain and an intracellular localization domain described herein. In some embodiments, preventing fratricide of CD70-TFP expressing T-cells comprises transducing a recombinant nucleic acid encoding anti-CD70 TFP described herein, e.g., a vector comprising recombinant nucleic acid encoding the anti-CD70 TFP described herein, into a T cell and transducing a recombinant nucleic acid encoding a fusion protein comprising a CD70 antibody domain and an intracellular localization domain described herein, e.g., a vector encoding the fusion protein, into the T cell, before or after transduction of the T cell with the recombinant nucleic acid encoding the anti-CD70 TFP. In some embodiments, preventing or reducing fratricide of CD70-TFP expressing T-cells comprises transducing the recombinant nucleic acid encoding an anti-CD70 TFP described herein into a T cell simultaneously with a nucleic acid encoding a fusion protein comprising a CD70 antibody domain and an intracellular localization domain described herein. In some embodiments, the recombinant nucleic acid molecule or vector encoding the CD70-TFP further comprises the sequence encoding the fusion protein. In some embodiments, the sequence encoding the CD70-TFP and the sequence encoding the fusion protein are contained in a single operon.

In some embodiments, reducing or preventing fratricide of CD70-TFP expressing T-cells comprises transducing the anti-CD70 TFP into a T cell having a functional disruption of an endogenous CD70 gene. In some embodiments, preventing fratricide of CD70-TFP expressing T-cells comprises transducing the anti-CD70 TFP into a T cell and disrupting an endogenous CD70 gene using the gene editing methods described herein, before or after transduction of the T cell with the anti-CD70 TFP. SEQ ID NOs. 744-749 are exemplary guide RNA sequences for use with the CRISPR/Cas9 system for disrupting endogenous CD70.

```
Exemplary guide RNA sequences for
disrupting endogenous CD70
                                  (SEQ ID NO: 744)
GTGCATCCAGCGCTTCGCAC

                                  (SEQ ID NO: 745)
ATCACCAAGCCCGCGACCAA

                                  (SEQ ID NO: 746)
CAGCTACGTATCCATCGTGA

                                  (SEQ ID NO: 747)
GCCCCCCTGCCAGTATAGCC

                                  (SEQ ID NO: 748)
GAGCTGCAGCTGAATCACAC

                                  (SEQ ID NO: 749)
CTCACCCCAAGTGACTCGAG
```

In some embodiments, reducing or preventing fratricide of CD70-TFP expressing T-cells comprises transducing the anti-CD70 TFP into a T cell having a functional disruption of an endogenous CIITA gene. In some embodiments, preventing fratricide of CD70-TFP expressing T-cells comprises transducing the anti-CD70 TFP into a T cell and disrupting an endogenous CIITA gene using the gene editing methods described herein, before or after transduction of the T cell with the anti-CD70 TFP. SEQ ID NOs. 750-755 are exemplary guide RNA sequences for use with the CRISPR/Cas9 system for disrupting endogenous CIITA.

```
Exemplary guide RNA sequences for
disrupting endogenous CIITA
                                  (SEQ ID NO: 750)
TTCCTACACAATGCGTTGCC
```

-continued

```
                                  (SEQ ID NO: 751)
GATATTGGCATAAGCCTCCC

                                  (SEQ ID NO: 752)
TCAACTGCGACCAGTTCAGC

                                  (SEQ ID NO: 753)
CATCGCTGTTAAGAAGCTCC

                                  (SEQ ID NO: 754)
GCCCCTAGAAGGTGGCTACC

                                  (SEQ ID NO: 755)
TCCTACCTGTCAGAGCCCCA
```

As is described above, in some embodiments, multiplex genomic editing techniques are applied to generate gene-disrupted T cells that are deficient in the expression of endogenous TCR, and/or human leukocyte antigens (HLAs), and/or programmed cell death protein 1 (PD1), and/or CD70 and/or CIITA and/or other genes.

In some embodiments, reducing or preventing fratricide of CD70-TFP expressing T-cells comprises contacting the cell with an antisense oligonucleotide targeting CD70, before or after transduction of the T cell with the recombinant nucleic acid encoding anti-CD70 TFP. In some embodiments, reducing or preventing fratricide of CD70-TFP expressing T-cells comprises transducing the recombinant nucleic acid encoding anti-CD70 TFP into a T cell having a sequence encoding an siRNA, shRNA, or miRNA targeting the CD70 gene. In some embodiments, preventing fratricide of CD70-TFP expressing T-cells comprises transducing the recombinant nucleic acid encoding anti-CD70 TFP into a T cell and transducing a nucleic acid encoding an siRNA, shRNA, or miRNA targeting the CD70 gene into the T cell, before or after transduction of the T cell with the anti-CD70 TFP. In some embodiments, preventing or reducing fratricide of CD70-TFP expressing T-cells comprises transducing the recombinant nucleic acid encoding anti-CD70 TFP into a T cell simultaneously with a nucleic acid encoding an siRNA, shRNA, or miRNA targeting the CD70 gene. In some embodiments, the CD70-TFP and the siRNA, shRNA, or miRNA are encoded by the same nucleic acid molecule.

In some embodiments, reducing or preventing fratricide of CD70-TFP expressing T-cells comprises contacting the cell with an antisense oligonucleotide targeting CIITA, before or after transduction of the T cell with the recombinant nucleic acid encoding anti-CD70 TFP. In some embodiments, reducing or preventing fratricide of CD70-TFP expressing T-cells comprises transducing the recombinant nucleic acid encoding anti-CD70 TFP into a T cell having a sequence encoding an siRNA, shRNA, or miRNA targeting the CIITA gene. In some embodiments, preventing fratricide of CD70-TFP expressing T-cells comprises transducing the recombinant nucleic acid encoding anti-CD70 TFP into a T cell and transducing a nucleic acid encoding an siRNA, shRNA, or miRNA targeting the CIITA gene into the T cell, before or after transduction of the T cell with the anti-CD70 TFP. In some embodiments, preventing or reducing fratricide of CD70-TFP expressing T-cells comprises transducing the recombinant nucleic acid encoding anti-CD70 TFP into a T cell simultaneously with a nucleic acid encoding an siRNA, shRNA, or miRNA targeting the CIITA gene. In some embodiments, the CD70-TFP and the siRNA, shRNA, or miRNA are encoded by the same nucleic acid molecule.

In some embodiments, the CD70-TFP is resistant to fratricide. In some embodiments, the CD70-TFP does not have increase fratricide relative to a TFP having a different antigen binding domain. In some embodiments, the CD70-TFP has reduced fratricide relative to a CD70-TFP that exhibits fratricide. In some embodiments, a method of producing T cells comprising a fratricide-resistant CD70 TFP described herein or a recombinant nucleic acid molecule encoding a fratricide-resistant CD70-TFP described herein does not comprise reducing or preventing fratricide of T cells. In some embodiments, the fratricide-resistant CD70 TFP comprises a scFv or fragment thereof. The scFv or fragment thereof can comprise a VH domain having a sequence of SEQ ID NO: 800. The scFv or fragment thereof can comprise a VL domain having a sequence of SEQ ID NO: 1012. The VH domain can comprise a CDRH1 having a sequence of SEQ ID NO: 853, a CDRH2 having a sequence of SEQ ID NO: 906, and a CDRH3 having a sequence of SEQ ID NO: 959. The VL domain can comprise a CDRL1 having a sequence of SEQ ID NO: 1065, a CDRL2 having a sequence of SEQ ID NO: 1118, and a CDRL3 having a sequence of SEQ ID NO: 1171.

Gene Editing of TCR Complex or Endogenous Protein-Coding Genes

In some embodiments, the modified T cells disclosed herein are engineered using a gene editing technique such as clustered regularly interspaced short palindromic repeats (CRISPR®, see, e.g., U.S. Pat. No. 8,697,359), transcription activator-like effector (TALE) nucleases (TALENs, see, e.g., U.S. Pat. No. 9,393,257), meganucleases (endodeoxyribonucleases having large recognition sites comprising double-stranded DNA sequences of 12 to 40 base pairs), zinc finger nuclease (ZFN, see, e.g., Urnov et al., *Nat. Rev. Genetics* (2010) v11, 636-646), or megaTAL nucleases (a fusion protein of a meganuclease to TAL repeats) methods. In this way, a chimeric construct may be engineered to combine desirable characteristics of each subunit, such as conformation or signaling capabilities. See also Sander & Joung, *Nat. Biotech.* (2014) v32, 347-55; and June et al., 2009 *Nature Reviews Immunol.* 9.10: 704-716, each incorporated herein by reference. In some embodiments, one or more of the extracellular domain, the transmembrane domain, or the cytoplasmic domain of a TFP subunit are engineered to have aspects of more than one natural TCR subunit domain (i.e., are chimeric).

Recent developments of technologies to permanently alter the human genome and to introduce site-specific genome modifications in disease relevant genes lay the foundation for therapeutic applications. These technologies are now commonly known as "genome editing.

In some embodiments, gene editing techniques are employed to disrupt an endogenous TCR or B2M gene. In some embodiments, mentioned endogenous TCR gene encodes a TCR alpha chain, a TCR beta chain, or a TCR alpha chain and a TCR beta chain. In some embodiments, mentioned endogenous TCR gene encodes a TCR gamma chain, a TCR delta chain, or a TCR gamma chain and a TCR delta chain. In some embodiments, gene editing techniques pave the way for multiplex genomic editing, which allows simultaneous disruption of multiple genomic loci in endogenous TCR gene. In some embodiments, multiplex genomic editing techniques are applied to generate gene-disrupted T cells that are deficient in the expression of endogenous TCR, and/or human leukocyte antigens (HLAs), and/or programmed cell death protein 1 (PD1), and/or other genes.

Current gene editing technologies comprise meganucleases, zinc-finger nucleases (ZFN), TAL effector nucleases (TALEN), and clustered regularly interspaced short palindromic repeats (CRISPR)/CRISPR-associated (Cas) system. These four major classes of gene-editing techniques share a common mode of action in binding a user-defined sequence of DNA and mediating a double-stranded DNA break (DSB). DSB may then be repaired by either non-homologous end joining (NHEJ) or—when donor DNA is present—homologous recombination (HR), an event that introduces the homologous sequence from a donor DNA fragment. Additionally, nickase nucleases generate single-stranded DNA breaks (SSB). DSBs may be repaired by single strand DNA incorporation (ssDI) or single strand template repair (ssTR), an event that introduces the homologous sequence from a donor DNA.

Genetic modification of genomic DNA can be performed using site-specific, rare-cutting endonucleases that are engineered to recognize DNA sequences in the locus of interest. Methods for producing engineered, site-specific endonucleases are known in the art. For example, zinc-finger nucleases (ZFNs) can be engineered to recognize and cut predetermined sites in a genome. ZFNs are chimeric proteins comprising a zinc finger DNA-binding domain fused to the nuclease domain of the Fokl restriction enzyme. The zinc finger domain can be redesigned through rational or experimental means to produce a protein that binds to a predetermined DNA sequence ~18 basepairs in length. By fusing this engineered protein domain to the Fokl nuclease, it is possible to target DNA breaks with genome-level specificity. ZFNs have been used extensively to target gene addition, removal, and substitution in a wide range of eukaryotic organisms (reviewed in Durai et al. (2005) *Nucleic Acids Res* 33, 5978). Likewise, TAL-effector nucleases (TALENs) can be generated to cleave specific sites in genomic DNA. Like a ZFN, a TALEN comprises an engineered, site-specific DNA-binding domain fused to the Fokl nuclease domain (reviewed in Mak et al. (2013), *Curr Opin StructBiol.* 23:93-9). In this case, however, the DNA binding domain comprises a tandem array of TAL-effector domains, each of which specifically recognizes a single DNA basepair. Compact TALENs have an alternative endonuclease architecture that avoids the need for dimerization (Beurdeley et al. (2013), *Nat Commun.* 4: 1762). A Compact TALEN comprises an engineered, site-specific TAL-effector DNA-binding domain fused to the nuclease domain from the I-TevI homing endonuclease. Unlike Fokl, I-TevI does not need to dimerize to produce a double-strand DNA break so a Compact TALEN is functional as a monomer.

Engineered endonucleases based on the CRISPR/Cas9 system are also known in the art (Ran et al. (2013), *Nat Protoc.* 8:2281-2308; Mali et al. (2013), *Nat Methods* 10:957-63). The CRISPR gene-editing technology is composed of an endonuclease protein whose DNA-targeting specificity and cutting activity can be programmed by a short guide RNA or a duplex crRNA/TracrRNA. A CRISPR endonuclease comprises two components: (1) a caspase effector nuclease, typically microbial Cas9; and (2) a short "guide RNA" or a RNA duplex comprising a 18 to 20 nucleotide targeting sequence that directs the nuclease to a location of interest in the genome. By expressing multiple guide RNAs in the same cell, each having a different targeting sequence, it is possible to target DNA breaks simultaneously to multiple sites in the genome (multiplex genomic editing).

There are two classes of CRISPR systems known in the art (Adli (2018) *Nat. Commun.* 9:1911), each containing multiple CRISPR types. Class 1 contains type I and type III CRISPR systems that are commonly found in Archaea. And, Class II contains type II, IV, V, and VI CRISPR systems. Although the most widely used CRISPR/Cas system is the type II CRISPR-Cas9 system, CRISPR/Cas systems have been repurposed by researchers for genome editing. More than 10 different CRISPR/Cas proteins have been remodeled within last few years (Adli (2018)*Nat. Commun.* 9:1911). Among these, such as Cas12a (Cpf1) proteins from Acid-*aminococcus* sp (AsCpf1) and Lachnospiraceae bacterium (LbCpf1), are particularly interesting.

Homing endonucleases are a group of naturally occurring nucleases that recognize 15-40 base-pair cleavage sites commonly found in the genomes of plants and fungi. They are frequently associated with parasitic DNA elements, such as group 1 self-splicing introns and inteins. They naturally promote homologous recombination or gene insertion at specific locations in the host genome by producing a double-stranded break in the chromosome, which recruits the cellular DNA-repair machinery (Stoddard (2006), *Q. Rev. Biophys.* 38: 49-95). Specific amino acid substations could reprogram DNA cleavage specificity of homing nucleases (Niyonzima (2017), *Protein Eng Des Sel.* 30(7): 503-522). Meganucleases (MN) are monomeric proteins with innate nuclease activity that are derived from bacterial homing endonucleases and engineered for a unique target site (Gersbach (2016), *Molecular Therapy.* 24: 430-446). In some embodiments, meganuclease is engineered I-CreI homing endonuclease. In other embodiments, meganuclease is engineered I-SceI homing endonuclease.

In addition to mentioned four major gene editing technologies, chimeric proteins comprising fusions of meganucleases, ZFNs, and TALENs have been engineered to generate novel monomeric enzymes that take advantage of the binding affinity of ZFNs and TALENs and the cleavage specificity of meganucleases (Gersbach (2016), *Molecular Therapy.* 24: 430-446). For example, A megaTAL is a single chimeric protein, which is the combination of the easy-to-tailor DNA binding domains from TALENs with the high cleavage efficiency of meganucleases.

In order to perform the gene editing technique, the nucleases, and in the case of the CRISPR/Cas9 system, a gRNA, must be efficiently delivered to the cells of interest. Delivery methods such as physical, chemical, and viral methods are also know in the art (Mali (2013). Indian J. Hum. Genet. 19: 3-8.). In some instances, physical delivery methods can be selected from the methods but not limited to electroporation, microinjection, or use of ballistic particles. On the other hand, chemical delivery methods require use of complex molecules such calcium phosphate, lipid, or protein. In some embodiments, viral delivery methods are applied for gene editing techniques using viruses such as but not limited to adenovirus, lentivirus, and retrovirus.

Therapeutic Applications

The TFP T cells provided herein may be useful for the treatment of any disease or condition involving CD70 (e.g., CD70-expressing cancers). In some embodiments, the disease or condition is a disease or condition that can benefit from treatment with adoptive cell therapy. In some embodiments, the disease or condition is a cell proliferative disorder. In some embodiments, the disease or condition is a cancer. In some embodiments, the disease or condition is a blood cancer. In some embodiments, the disease or condition is a tumor. In some embodiments, the disease or condition is a viral infection.

In some embodiments, provided herein is a method of treating a disease or condition in a subject in need thereof by administering an effective amount of a TFP T cell provided herein to the subject. In some aspects, the disease or condition is a cancer. In some aspects, the disease or condition is a viral infection.

Any suitable cancer may be treated with the TFP T cells provided herein. Illustrative suitable cancers include, for example, acute lymphoblastic leukemia (ALL), acute myeloid leukemia (AML), adrenocortical carcinoma, anal cancer, appendix cancer, astrocytoma, basal cell carcinoma, brain tumor, bile duct cancer, bladder cancer, bone cancer, breast cancer, bronchial tumor, carcinoma of unknown primary origin, cardiac tumor, cervical cancer, chordoma, colon cancer, colorectal cancer, craniopharyngioma, ductal carcinoma, embryonal tumor, endometrial cancer, ependymoma, esophageal cancer, esthesioneuroblastoma, fibrous histiocytoma, Ewing sarcoma, eye cancer, germ cell tumor, gallbladder cancer, gastric cancer, gastrointestinal carcinoid tumor, gastrointestinal stromal tumor, gestational trophoblastic disease, glioma, head and neck cancer, hepatocellular cancer, histiocytosis, Hodgkin lymphoma, hypopharyngeal cancer, intraocular melanoma, islet cell tumor, Kaposi sarcoma, kidney cancer, Langerhans cell histiocytosis, laryngeal cancer, lip and oral cavity cancer, liver cancer, lobular carcinoma in situ, lung cancer, macroglobulinemia, malignant fibrous histiocytoma, melanoma, Merkel cell carcinoma, mesothelioma, metastatic squamous neck cancer with occult primary, midline tract carcinoma involving NUT gene, mouth cancer, multiple endocrine neoplasia syndrome, multiple myeloma, mycosis fungoides, myelodysplastic syndrome, myelodysplastic/myeloproliferative neoplasm, nasal cavity and par nasal sinus cancer, nasopharyngeal cancer, neuroblastoma, non-small cell lung cancer, oropharyngeal cancer, osteosarcoma, ovarian cancer, pancreatic cancer, papillomatosis, paraganglioma, parathyroid cancer, penile cancer, pharyngeal cancer, pheochromocytomas, pituitary tumor, pleuropulmonary blastoma, primary central nervous system lymphoma, prostate cancer, rectal cancer, renal cell cancer, renal pelvis and ureter cancer, retinoblastoma, rhabdoid tumor, salivary gland cancer, Sezary syndrome, skin cancer, small cell lung cancer, small intestine cancer, soft tissue sarcoma, spinal cord tumor, stomach cancer, T cell lymphoma, teratoid tumor, testicular cancer, throat cancer, thymoma and thymic carcinoma, thyroid cancer, urethral cancer, uterine cancer, vaginal cancer, vulvar cancer, and Wilms tumor.

In some cases, the cancer can be acute lymphocytic cancer, acute myeloid leukemia, alveolar rhabdomyosarcoma, bladder cancer (e.g., bladder carcinoma), bone cancer, brain cancer (e.g., medulloblastoma), breast cancer, cancer of the anus, anal canal, or anorectum, cancer of the eye, cancer of the intrahepatic bile duct, cancer of the joints, cancer of the neck, gallbladder, or pleura, cancer of the nose, nasal cavity, or middle ear, cancer of the oral cavity, cancer of the vulva, chronic lymphocytic leukemia (CLL), chronic myeloid cancer, colon cancer, esophageal cancer, cervical cancer, fibrosarcoma, gastrointestinal carcinoid tumor, head and neck cancer (e.g., head and neck squamous cell carcinoma), glioblastoma, Hodgkin's lymphoma, hypopharynx cancer, kidney cancer, larynx cancer, leukemia, liquid tumors, liver cancer, lung cancer (e.g., non-small cell lung carcinoma), lymphoma, diffuse large-B-cell lymphoma, follicular lymphoma, malignant mesothelioma, mastocytoma, melanoma, multiple myeloma, nasopharynx cancer, non-Hodgkin's lymphoma (NHL), B-chronic lymphocytic leukemia, hairy cell leukemia, acute lymphocytic leukemia (ALL), Burkitt's lymphoma, ovarian cancer, pancreatic cancer, peritoneum, omentum, mesentery cancer, pharynx cancer, prostate cancer, RCC, ccRCC, rectal cancer, renal cancer, skin cancer, small intestine cancer, soft tissue cancer, solid tumors, stomach cancer, testicular cancer, thyroid cancer, or ureter cancer. The cancer can be characterized by the expression of CD70. In some cases, the CD70 can be highly expressed in multiple hematologic malignancies, such as non-Hodgkin lymphoma, multiple myeloma, and chronic lymphocytic leukemia, and can be highly expressed in the solid tumor type clear cell renal cell carcinoma (ccRCC). In some cases, the cancer can be any of RCC (for example, ccRCC), glioblastoma, NHL, CLL, diffuse large-B-cell lymphoma, and follicular lymphoma.

Methods of Treatment

In one aspect, the invention provides methods for treating a disease associated with at least one tumor-associated antigen expression. In one aspect, the invention provides methods for treating a disease wherein part of the tumor is negative for the tumor associated antigen and part of the tumor is positive for the tumor associated antigen. For example, the antibody or TFP of the invention is useful for treating subjects that have undergone treatment for a disease associated with elevated expression of said tumor antigen, wherein the subject that has undergone treatment for elevated levels of the tumor associated antigen exhibits a disease associated with elevated levels of the tumor associated antigen.

In one aspect, the invention pertains to a vector comprising an anti-tumor-associated antigen antibody or TFP operably linked to promoter for expression in mammalian T cells. In one aspect, the invention provides a recombinant T cell expressing a tumor-associated antigen TFP for use in treating tumor-associated antigen-expressing tumors, wherein the recombinant T cell expressing the tumor-associated antigen TFP is termed a tumor-associated antigen TFP-T. In one aspect, the tumor-associated antigen TFP-T of the invention is capable of contacting a tumor cell with at least one tumor-associated antigen TFP of the invention expressed on its surface such that the TFP-T targets the tumor cell and growth of the tumor is inhibited.

In one aspect, the invention pertains to a method of inhibiting growth of a tumor-associated antigen-expressing tumor cell, comprising contacting the tumor cell with a tumor-associated antigen antibody or TFP T cell of the present invention such that the TFP-T is activated in response to the antigen and targets the cancer cell, wherein the growth of the tumor is inhibited.

In one aspect, the invention pertains to a method of treating cancer in a subject. The method comprises administering to the subject a tumor-associated antigen antibody, bispecific antibody, or TFP T cell of the present invention such that the cancer is treated in the subject. An example of a cancer that is treatable by the tumor-associated antigen TFP T cell of the invention is a cancer associated with expression of tumor-associated antigen.

In some embodiments, tumor-associated antigen antibodies or TFP therapy can be used in combination with one or more additional therapies described herein.

In one aspect, disclosed herein is a method of cellular therapy wherein T cells are genetically modified to express a TFP and the TFP-expressing T cell is infused to a recipient in need thereof. The infused cell is able to kill tumor cells in the recipient. Unlike antibody therapies, TFP-expressing T cells are able to replicate in vivo resulting in long-term persistence that can lead to sustained tumor control. In various aspects, the T cells administered to the patient, or their progeny, persist in the patient for at least four months, five months, six months, seven months, eight months, nine months, ten months, eleven months, twelve months, thirteen months, fourteen month, fifteen months, sixteen months, seventeen months, eighteen months, nineteen months, twenty months, twenty-one months, twenty-two months, twenty-three months, two years, three years, four years, or five years after administration of the T cell to the patient.

In some instances, disclosed herein is a type of cellular therapy where T cells are modified, e.g., by in vitro transcribed RNA, to transiently express a TFP and the TFP-expressing T cell is infused to a recipient in need thereof. The infused cell is able to kill tumor cells in the recipient. Thus, in various aspects, the T cells administered to the patient, is present for less than one month, e.g., three weeks, two weeks, or one week, after administration of the T cell to the patient.

Without wishing to be bound by any particular theory, the anti-tumor immunity response elicited by the TFP-expressing T cells may be an active or a passive immune response, or alternatively may be due to a direct vs indirect immune response. In one aspect, the TFP transduced T cells exhibit specific proinflammatory cytokine secretion and potent cytolytic activity in response to human cancer cells expressing the tumor-associated antigen, resist soluble tumor-associated antigen inhibition, mediate bystander killing and/or mediate regression of an established human tumor. For example, antigen-less tumor cells within a heterogeneous field of tumor-associated antigen-expressing tumor may be susceptible to indirect destruction by tumor-associated antigen-redirected T cells that has previously reacted against adjacent antigen-positive cancer cells.

In one aspect, the human TFP-modified T cells of the invention may be a type of vaccine for ex vivo immunization and/or in vivo therapy in a mammal. In one aspect, the mammal is a human.

With respect to ex vivo immunization, at least one of the following occurs in vitro prior to administering the cell into a mammal: i) expansion of the cells, ii) introducing a nucleic acid encoding a TFP to the cells or iii) cryopreservation of the cells, as is described herein.

In addition to using a cell-based vaccine in terms of ex vivo immunization, the present invention also provides compositions and methods for in vivo immunization to elicit an immune response directed against an antigen in a patient.

Generally, the cells activated and expanded as described herein may be utilized in the treatment and prevention of diseases that arise in individuals who are immunocompromised. In particular, the TFP-modified T cells of the invention are used in the treatment of diseases, disorders and conditions associated with expression of tumor-associated antigens. In certain aspects, the cells of the invention are used in the treatment of patients at risk for developing diseases, disorders and conditions associated with expression of tumor-associated antigens. Thus, the present invention provides methods for the treatment or prevention of diseases, disorders and conditions associated with expression of tumor-associated antigens comprising administering to a subject in need thereof, a therapeutically effective amount of the TFP-modified T cells of the invention.

The antibodies or TFP-modified T cells of the present invention may be administered either alone, or as a pharmaceutical composition in combination with diluents and/or with other components as is described in further detail below.

The present invention also provides methods for inhibiting the proliferation or reducing a tumor-associated antigen-expressing cell population, the methods comprising contacting a population of cells comprising a tumor-associated antigen-expressing cell with an anti-tumor-associated antigen TFP-T cell of the invention that binds to the tumor-associated antigen-expressing cell. In a specific aspect, the present invention provides methods for inhibiting the proliferation or reducing the population of cancer cells expressing tumor-associated antigen, the methods comprising contacting the tumor-associated antigen-expressing cancer cell population with an anti-tumor-associated antigen antibody or TFP-T cell of the invention that binds to the tumor-associated antigen-expressing cell. In one aspect, the present invention provides methods for inhibiting the proliferation or reducing the population of cancer cells expressing tumor-associated antigen, the methods comprising contacting the tumor-associated antigen-expressing cancer cell population with an anti-tumor-associated antigen antibody or TFP-T cell of the invention that binds to the tumor-associated antigen-expressing cell. In certain aspects, the anti-tumor-associated antigen antibody or TFP-T cell of the invention reduces the quantity, number, amount or percentage of cells and/or cancer cells by at least 25%, at least 30%, at least 40%, at least 50%, at least 65%, at least 75%, at least 85%, at least 95%, or at least 99% in a subject with or animal model for multiple myeloma or another cancer associated with tumor-associated antigen-expressing cells relative to a negative control. In one aspect, the subject is a human.

The present invention also provides methods for preventing, treating and/or managing a disease associated with tumor-associated antigen-expressing cells (e.g., a cancer expressing tumor-associated antigen), the methods comprising administering to a subject in need an anti-tumor-associated antigen antibody or TFP-T cell of the invention that binds to the tumor-associated antigen-expressing cell. In one aspect, the subject is a human. Non-limiting examples of disorders associated with tumor-associated antigen-expressing cells include autoimmune disorders (such as lupus), inflammatory disorders (such as allergies and asthma) and cancers (such as hematological cancers or atypical cancers expressing tumor-associated antigen).

Suitable doses of the TFP-T cells described herein for a therapeutic effect would be at least 105 or between about $10^5$ and about $10^{10}$ cells per dose, for example, preferably in a series of dosing cycles. An exemplary dosing regimen consists of four one-week dosing cycles of escalating doses, starting at least at about $10^5$ cells on Day 0, for example increasing incrementally up to a target dose of about $10^{10}$ cells within several weeks of initiating an intra-patient dose escalation scheme. Suitable modes of administration include intravenous, subcutaneous, intracavitary (for example by reservoir-access device), intraperitoneal, and direct injection into a tumor mass.

An effective amount or sufficient number of the isolated, T cells is present in the composition and introduced into the subject such that long-term, specific, anti-cancer and/or anti-tumor responses are established to reduce the size of a tumor or eliminate tumor growth or regrowth than would otherwise result in the absence of such treatment. Desirably, the amount of T cells introduced into the subject causes a 10%, 20%, 30%, 40%, 50%, 60%, 70%, 80%, 90%, 95%, 98%, or 100% decrease in tumor size when compared to otherwise same conditions wherein the T cells are not present.

Accordingly, the amount of T cells administered should take into account the route of administration and should be such that a sufficient number of the T cells will be introduced so as to achieve the desired therapeutic response. Furthermore, the amounts of each active agent included in the compositions described herein (e.g., the amount per each cell to be contacted or the amount per certain body weight) can vary in different applications.

Combination Therapies

An antibody or TFP-expressing cell described herein may be used in combination with other known agents and therapies. Administered "in combination", as used herein, means that two (or more) different treatments are delivered to the subject during the course of the subject's affliction with the disorder, e.g., the two or more treatments are delivered after the subject has been diagnosed with the disorder and before the disorder has been cured or eliminated or treatment has ceased for other reasons. In some embodiments, the delivery of one treatment is still occurring when the delivery of the second begins, so that there is overlap in terms of administration. This is sometimes referred to herein as "simultaneous" or "concurrent delivery". In other embodiments, the delivery of one treatment ends before the delivery of the other treatment begins. In some embodiments of either case, the treatment is more effective because of combined administration. For example, the second treatment is more effective, e.g., an equivalent effect is seen with less of the second treatment, or the second treatment reduces symptoms to a greater extent, than would be seen if the second treatment were administered in the absence of the first treatment or the analogous situation is seen with the first treatment. In some embodiments, delivery is such that the reduction in a symptom, or other parameter related to the disorder is greater than what would be observed with one treatment delivered in the absence of the other. The effect of the two treatments can be partially additive, wholly additive, or greater than additive. The delivery can be such that an effect of the first treatment delivered is still detectable when the second is delivered.

In some embodiments, the "at least one additional therapeutic agent" includes a TFP– expressing cell. Also provided are T cells that express multiple TFPs, which bind to the same or different target antigens, or same or different epitopes on the same target antigen. Also provided are populations of T cells in which a first subset of T cells expresses a first TFP and a second subset of T cells expresses a second TFP.

A TFP-expressing cell described herein and the at least one additional therapeutic agent can be administered simultaneously, in the same or in separate compositions, or sequentially. For sequential administration, the TFP-expressing cell described herein can be administered first, and the additional agent can be administered second, or the order of administration can be reversed.

In some embodiments, the TFP T cells provided herein are administered with at least one additional therapeutic agent. Any suitable additional therapeutic agent may be administered with a TFP T cell provided herein. In some aspects, the additional therapeutic agent is selected from radiation, a cytotoxic agent, a chemotherapeutic agent, a cytostatic agent, an anti-hormonal agent, an EGFR inhibitor, an immunostimulatory agent, an anti-angiogenic agent, and combinations thereof.

In further aspects, a TFP-expressing cell described herein may be used in a treatment regimen in combination with surgery, chemotherapy, radiation, immunosuppressive agents, such as cyclosporin, azathioprine, methotrexate, mycophenolate, and tacrolimus, antibodies, or other immunoablative agents such as alemtuzumab, anti-CD3 antibodies or other antibody therapies, cyclophosphamide, fludarabine, cyclosporin, tacrolimus, rapamycin, mycophenolic acid, steroids, romidepsin, cytokines, and irradiation. peptide vaccine, such as that described in Izumoto et al. 2008 J Neurosurg 108:963-971.

In one embodiment, the subject can be administered an agent which reduces or ameliorates a side effect associated with the administration of a TFP-expressing cell. Side effects associated with the administration of a TFP-expressing cell include, but are not limited to, cytokine release syndrome (CRS), and hemophagocytic lymphohistiocytosis (HLH), also termed Macrophage Activation Syndrome (MAS). Symptoms of CRS include high fevers, nausea, transient hypotension, hypoxia, and the like. Accordingly, the methods described herein can comprise administering a TFP– expressing cell described herein to a subject and further administering an agent to manage elevated levels of a soluble factor resulting from treatment with a TFP-expressing cell. In one embodiment, the soluble factor elevated in the subject is one or more of IFN-γ, TNFα, IL-2 and IL-6. Therefore, an agent administered to treat this side effect can be an agent that neutralizes one or more of these soluble factors. Such agents include, but are not limited to a steroid, an inhibitor of TNFα, and an inhibitor of IL-6. An example of a TNFα inhibitor is etanercept (marketed under the name ENBREL®). An example of an IL-6 inhibitor is tocilizumab (marketed under the name ACTEMRA®).

In one embodiment, the subject can be administered an agent which enhances the activity of a TFP-expressing cell. For example, in one embodiment, the agent can be an agent which inhibits an inhibitory molecule. Inhibitory molecules, e.g., Programmed Death 1 (PD1), can, in some embodiments, decrease the ability of a TFP-expressing cell to mount an immune effector response. Examples of inhibitory molecules include PD1, PD-L1, CTLA4, TIM3, LAG3, VISTA, BTLA, TIGIT, LAIR1, CD160, 2B4 and TGFR beta. Inhibition of an inhibitory molecule, e.g., by inhibition at the DNA, RNA or protein level, can optimize a TFP-expressing cell performance. In embodiments, an inhibitory nucleic acid, e.g., an inhibitory nucleic acid, e.g., a dsRNA, e.g., an siRNA or shRNA, can be used to inhibit expression of an inhibitory molecule in the TFP-expressing cell. In an embodiment, the inhibitor is a shRNA. In an embodiment, the inhibitory molecule is inhibited within a TFP-expressing cell. In these embodiments, a dsRNA molecule that inhibits expression of the inhibitory molecule is linked to the nucleic acid that encodes a component, e.g., all of the components, of the TFP. In one embodiment, the inhibitor of an inhibitory signal can be, e.g., an antibody or antibody fragment that binds to an inhibitory molecule. For example, the agent can be an antibody or antibody fragment that binds to PD1, PD-L1, PD-L2 or CTLA4 (e.g., ipilimumab (also referred to as MDX-010 and MDX-101, and marketed as YERVOY®; Bristol-Myers Squibb; tremelimumab (IgG2 monoclonal antibody available from Pfizer, formerly known as ticilimumab, CP-675,206)). In an embodiment, the agent is an antibody or antibody fragment that binds to T cell immunoglobulin and mucin-domain containing-3 (TIM3). In an embodiment, the agent is an antibody or antibody fragment that binds to Lymphocyte-activation gene 3 (LAG3).

In some embodiments, the agent which enhances the activity of a TFP-expressing cell can be, e.g., a fusion protein comprising a first domain and a second domain, wherein the first domain is an inhibitory molecule, or fragment thereof, and the second domain is a polypeptide that is associated with a positive signal, e.g., a polypeptide comprising an intracellular signaling domain as described herein. In some embodiments, the polypeptide that is associated with a positive signal can include a costimulatory domain of CD28, CD27, ICOS, e.g., an intracellular signaling domain of CD28, CD27 and/or ICOS, and/or a primary signaling domain, e.g., of CD3 zeta, e.g., described herein. In one embodiment, the fusion protein is expressed by the same cell that expressed the TFP. In another embodiment, the fusion protein is expressed by a cell, e.g., a T cell that does not express an anti-tumor-associated antigen TFP.

In some embodiments, the additional therapeutic agent comprises an immunostimulatory agent.

In some embodiments, the immunostimulatory agent is an agent that blocks signaling of an inhibitory receptor of an immune cell, or a ligand thereof. In some aspects, the inhibitory receptor or ligand is selected from cytotoxic T-lymphocyte-associated protein 4 (CTLA-4, also known as CD152), programmed cell death protein 1 (also PD-1 or CD279), programmed death ligand 1 (also PD-L1 or CD274), transforming growth factor beta (TGFβ), lymphocyte-activation gene 3 (LAG-3, also CD223), Tim-3 (hepatitis A virus cellular receptor 2 or HAVCR2 or CD366), neuritin, B- and T-lymphocyte attenuator (also BTLA or CD272), killer cell immunoglobulin-like receptors (KIRs), and combinations thereof. In some aspects, the agent is selected from an anti-PD-1 antibody (e.g., pembrolizumab or nivolumab), and anti-PD-L1 antibody (e.g., atezolizumab), an anti-CTLA-4 antibody (e.g., ipilimumab), an anti-TIM3 antibody, carcinoembryonic antigen-related cell adhesion molecule 1 (CECAM-1, also CD66a) and 5 (CEACAM-5, also CD66e), vset immunoregulatory receptor (also VISR or VISTA), leukocyte-associated immunoglobulin-like receptor 1 (also LAIR1 or CD305), CD160, natural killer cell receptor 2B4 (also CD244 or SLAMF4), and combinations thereof. In some aspects, the agent is pembrolizumab. In some aspects, the agent is nivolumab. In some aspects, the agent is atezolizumab.

In some embodiments, the additional therapeutic agent is an agent that inhibits the interaction between PD-1 and PD-L1. In some aspects, the additional therapeutic agent that inhibits the interaction between PD-1 and PD-L1 is selected from an antibody, a peptidomimetic and a small molecule. In some aspects, the additional therapeutic agent that inhibits the interaction between PD-1 and PD-L1 is selected from pembrolizumab (KEYTRUDA), nivolumab (OPDIVO), atezolizumab, avelumab, pidilizumab, durvalumab, sulfamonomethoxine 1, and sulfamethizole 2. In some embodiments, the additional therapeutic agent that inhibits the interaction between PD-1 and PD-L1 is any therapeutic known in the art to have such activity, for example as described in Weinmann et al., *Chem Med Chem,* 2016, 14:1576 (DOI: 10.1002/cmdc.201500566), incorporated by reference in its entirety. In some embodiments, the agent that inhibits the interaction between PD-1 and PD-L1 is formulated in the same pharmaceutical composition an antibody provided herein. In some embodiments, the agent that inhibits the interaction between PD-1 and PD-L1 is formulated in a different pharmaceutical composition from an antibody provided herein. In some embodiments, the agent that inhibits the interaction between PD-1 and PD-L1 is administered prior to administration of an antibody provided herein. In some embodiments, the agent that inhibits the interaction between PD-1 and PD-L1 is administered after administration of an antibody provided herein. In some embodiments, the agent that inhibits the interaction between PD-1 and PD-L1 is administered contemporaneously with an antibody provided herein, but the agent and antibody are administered in separate pharmaceutical compositions.

In some embodiments, the immunostimulatory agent is an agonist of a co-stimulatory receptor of an immune cell. In some aspects, the co-stimulatory receptor is selected from GITR, OX40, ICOS, LAG-2, CD27, CD28, 4-1BB, CD40, STING, a toll-like receptor, RIG-1, and a NOD-like receptor. In some embodiments, the agonist is an antibody.

In some embodiments, the immunostimulatory agent modulates the activity of arginase, indoleamine-2 3-dioxygenase, or the adenosine A2A receptor.

In some embodiments, the immunostimulatory agent is a cytokine. In some aspects, the cytokine is selected from IL-2, IL-5, IL-7, IL-12, IL-15, IL-21, and combinations thereof.

In some embodiments, the immunostimulatory agent is an oncolytic virus. In some aspects, the oncolytic virus is selected from a herpes simplex virus, a vesicular stomatitis virus, an adenovirus, a Newcastle disease virus, a vaccinia virus, and a maraba virus.

Further examples of additional therapeutic agents include a taxane (e.g., paclitaxel or docetaxel); a platinum agent (e.g., carboplatin, oxaliplatin, and/or cisplatin); a topoisomerase inhibitor (e.g., irinotecan, topotecan, etoposide, and/or mitoxantrone); folinic acid (e.g., leucovorin); or a nucleoside metabolic inhibitor (e.g., fluorouracil, capecitabine, and/or gemcitabine). In some embodiments, the additional therapeutic agent is folinic acid, 5-fluorouracil, and/or oxaliplatin. In some embodiments, the additional therapeutic agent is 5-fluorouracil and irinotecan. In some embodiments, the additional therapeutic agent is a taxane and a platinum agent. In some embodiments, the additional therapeutic agent is paclitaxel and carboplatin. In some embodiments, the additional therapeutic agent is pemetrexate. In some embodiments, the additional therapeutic agent is a targeted therapeutic such as an EGFR, RAF or MEK-targeted agent.

The additional therapeutic agent may be administered by any suitable means. In some embodiments, a medicament provided herein, and the additional therapeutic agent are included in the same pharmaceutical composition. In some embodiments, an antibody provided herein, and the additional therapeutic agent are included in different pharmaceutical compositions.

In embodiments where an antibody provided herein and the additional therapeutic agent are included in different pharmaceutical compositions, administration of the antibody can occur prior to, simultaneously, and/or following, administration of the additional therapeutic agent. In some aspects, administration of an antibody provided herein, and the additional therapeutic agent occur within about one month of each other. In some aspects, administration of an antibody provided herein, and the additional therapeutic agent occur within about one week of each other. In some aspects, administration of an antibody provided herein, and the additional therapeutic agent occur within about one day of each other. In some aspects, administration of an antibody provided herein, and the additional therapeutic agent occur within about twelve hours of each other. In some aspects, administration of an antibody provided herein, and the additional therapeutic agent occur within about one hour of each other.

In some embodiments, the additional therapeutic agent is an agent that increases levels of CD70 in cancer cells associated with elevated expression of CD70. In some embodiments, the agent that increases levels of CD70 is an agent that inhibits DNA methylation. In some embodiments, the agent that increases levels of CD70 is an agent that inhibits DNA methyltransferase. In some embodiments, the agent that increases levels of CD70 is a hypomethylating agent. Examples of the hypomethylating agent includes, but are not limited to 5-azacitidine and decitabine and also includes any hypomethylating agent known in the art. In some embodiments, the hypomethylating agent is 5-azacitidine. In some embodiments, the hypomethylating agent is decitabine. In some embodiments, the hypomethylating agent is a derivative of decitabine or a derivative of 5-azacitidine. In some embodiments, the hypomethylating agent is an esterificated azacytidine, an acetylated azacitidine, an esterificated decitabine, or an acetylated decitabine.

Diagnostic Methods

Also provided are methods for detecting the presence of CD70 on cells from a subject. Such methods may be used, for example, to predict and evaluate responsiveness to treatment with an antibody provided herein.

In some embodiments, a blood sample is obtained from a subject and the fraction of cells expressing CD70 is determined. In some aspects, the relative amount of CD70 expressed by such cells is determined. The fraction of cells expressing CD70 and the relative amount of CD70 expressed by such cells can be determined by any suitable method. In some embodiments, flow cytometry is used to make such measurements. In some embodiments, fluorescence assisted cell sorting (FACS) is used to make such measurement. See Li et al., *J. Autoimmunity,* 2003, 21:83-92 for methods of evaluating expression of CD70 in peripheral blood.

Tumor Antigen Associated Diseases or Disorders

Many patients treated with cancer therapeutics that are directed to one target on a tumor cell, e.g., BCMA, CD19, CD20, CD22, CD123, MUC16, MSLN, etc., become resistant over time as escape mechanisms such as alternate signaling pathways and feedback loops become activated. Dual specificity therapeutics attempt to address this by combining targets that often substitute for each other as escape routes. Therapeutic T cell populations having TCRs specific to more than one tumor-associated antigen are promising combination therapeutics. In some embodiments, the dual specificity TFP T cells are administered with an additional anti-cancer agent; in some embodiments, the anti-cancer agent is an antibody or fragment thereof, another TFP T cell, a CAR T cell, or a small molecule. Exemplary tumor-associated antigens include, but are not limited to, oncofetal antigens (e.g., those expressed in fetal tissues and in cancerous somatic cells), oncoviral antigens (e.g., those encoded by tumorigenic transforming viruses), overexpressed/accumulated antigens (e.g., those expressed by both normal and neoplastic tissue, with the level of expression highly elevated in neoplasia), cancer-testis antigens (e.g., those expressed only by cancer cells and adult reproductive tissues such as testis and placenta), lineage-restricted antigens (e.g., those expressed largely by a single cancer histotype), mutated antigens (e.g., those expressed by cancer as a result of genetic mutation or alteration in transcription), posttranslationally altered antigens (e.g., those tumor-associated alterations in glycosylation, etc.), and idiotypic antigens (e.g., those from highly polymorphic genes where a tumor cell expresses a specific clonotype, e.g., as in B cell, T cell lymphoma/leukemia resulting from clonal aberrancies). Exemplary tumor-associated antigens include, but are not limited to, antigens of alpha-actinin-4, ARTC1, alphafetoprotein (AFP), BCR-ABL fusion protein (b3a2), B-RAF, CASP-5, CASP-8, beta-catenin, Cdc27, CDK4, CDK12, CDKN2A, CLPP, COA-1, CSNK1A1, CD79, CD79B, dek-can fusion protein, EFTUD2, Elongation factor 2, ETV6-AML1 fusion protein, FLT3-ITD, FNDC3B, FN1, GAS7, GPNMB, HAUS3, HSDL1, LDLR-fucosyltransferase AS fusion protein, HLA-A2d, HLA-A11d, hsp70-2, MART2, MATN, ME1, MUM-1f, MUM-2, MUM-3, neo-PAP, Myosin class I, NFYC, OGT, OS-9, p53, pml-RARalpha fusion protein, PPP1R3B, PRDX5, PTPRK, K-ras, N-ras, RBAF600, SIRT2, SNRPD1, SYT-SSX1 or -SSX2 fusion protein, TGF-betaRII, triosephosphate isomerase, BAGE-1, D393-CD20n, Cyclin-A1, GAGE-1, GAGE-2, GAGE-8, GAGE-3, GAGE-4, GAGE-5, GAGE-6, GAGE-7, GnTVf, HERV-K-MEL, KK-LC-1, KM-HN-1, LAGE-1, LY6K, MAGE-A1, MAGE-A2, MAGE-A3, MAGE-A4, MAGE-A6, MAGE-A9, MAGE-A10, MAGE-A12 m, MAGE-C1, MAGE-C2, mucink, NA88-A, NY-ESO-1/LAGE-2, SAGE, Sp17, SSX-2, SSX-4, TAG-1, TAG-2, TRAG-3, TRP2-INT2g, XAGE-1b/GAGED2a, Gene/protein, CEA, gp100/Pmel17, mammaglobin-A, Melan-A/MART-1, NY-BR-1, OA1, PAP, PSA, RAB38/NY-MEL-1, TRP-1/gp75, TRP-2, tyrosinase, adipophilin, AIM-2, ALDH1A1, BCLX (L), BING-4, CALCA, CD45, CD274, CPSF, cyclin D1, DKK1, ENAH (hMena), EpCAM, EphA3, EZH2, FGF5, glypican-3, G250/MN/CAIX, HER-2/neu, HLA-DOB, Hepsin, IDO1, IGF2B3, IL13Ralpha2, Intestinal carboxyl esterase, alpha-foetoprotein, Kallikrein 4, KIF20A, Lengsin, M-CSF, MCSP, mdm-2, Meloe, Midkine, MMP-2, MMP-7, MUC1, MUC5AC, p53, PAX5, PBF, PRAME, PSMA, RAGE-1, RGS5, RhoC, RNF43, RU2AS, secernin 1, SOX10, STEAP1, survivin, Telomerase, TPBG, VEGF, and WT1.

Pharmaceutical Compositions

Pharmaceutical compositions of the present invention may comprise a TFP-expressing cell, e.g., a plurality of TFP-expressing cells, as described herein, in combination with one or more pharmaceutically or physiologically acceptable carriers, diluents or excipients. Such compositions may comprise buffers such as neutral buffered saline, phosphate buffered saline and the like; carbohydrates such as glucose, mannose, sucrose or dextrans, mannitol; proteins; polypeptides or amino acids such as glycine; antioxidants; chelating agents such as EDTA or glutathione; adjuvants (e.g., aluminum hydroxide); and preservatives. Compositions of the present invention are in one aspect formulated for intravenous administration.

Pharmaceutical compositions of the present invention may be administered in a manner appropriate to the disease to be treated (or prevented). The quantity and frequency of administration will be determined by such factors as the condition of the patient, and the type and severity of the patient's disease, although appropriate dosages may be determined by clinical trials.

In one embodiment, the pharmaceutical composition is substantially free of, e.g., there are no detectable levels of a contaminant, e.g., selected from the group consisting of endotoxin, mycoplasma, replication competent lentivirus (RCL), p24, VSV-G nucleic acid, HIV gag, residual anti-CD3/anti-CD28 coated beads, mouse antibodies, pooled human serum, bovine serum albumin, bovine serum, culture media components, vector packaging cell or plasmid components, a bacterium and a fungus. In one embodiment, the bacterium is at least one selected from the group consisting of *Alcaligenes faecalis, Candida albicans, Escherichia coli, Haemophilus influenza, Neisseria meningitides, Pseudomonas aeruginosa, Staphylococcus aureus, Streptococcus pneumonia*, and *Streptococcus pyogenes* group A.

When "an immunologically effective amount," "an anti-tumor effective amount," "a tumor-inhibiting effective amount," or "therapeutic amount" is indicated, the precise amount of the compositions of the present invention to be administered can be determined by a physician with consideration of individual differences in age, weight, tumor size, extent of infection or metastasis, and condition of the patient (subject). It can generally be stated that a pharmaceutical composition comprising the T cells described herein may be administered at a dosage of $10^4$ to $10^9$ cells/kg body weight, in some instances $10^5$ to $10^6$ cells/kg body weight, including all integer values within those ranges. T cell compositions may also be administered multiple times at these dosages. The cells can be administered by using infusion techniques that are commonly known in immunotherapy (see, e.g., Rosenberg et al., *New Eng. J. of Med.* 319:1676, 1988).

In certain aspects, it may be desired to administer activated T cells to a subject and then subsequently redraw blood (or have an apheresis performed), activate T cells therefrom according to the present invention, and reinfuse the patient with these activated and expanded T cells. This process can be carried out multiple times every few weeks. In certain aspects, T cells can be activated from blood draws of from 10 cc to 400 cc. In certain aspects, T cells are activated from blood draws of 20 cc, 30 cc, 40 cc, 50 cc, 60 cc, 70 cc, 80 cc, 90 cc, or 100 cc.

The administration of the subject compositions may be carried out in any convenient manner, including by aerosol inhalation, injection, ingestion, transfusion, implantation or transplantation. The compositions described herein may be administered to a patient trans arterially, subcutaneously, intradermally, intratumorally, intranodally, intramedullary, intramuscularly, by intravenous (i.v.) injection, or intraperitoneally. In one aspect, the T cell compositions of the present invention are administered to a patient by intradermal or subcutaneous injection. In one aspect, the T cell compositions of the present invention are administered by i.v. injection. The compositions of T cells may be injected directly into a tumor, lymph node, or site of infection.

In a particular exemplary aspect, subjects may undergo leukapheresis, wherein leukocytes are collected, enriched, or depleted ex vivo to select and/or isolate the cells of interest, e.g., T cells. These T cell isolates may be expanded by methods known in the art and treated such that one or more TFP constructs of the invention may be introduced, thereby creating a TFP-expressing T cell of the invention. Subjects in need thereof may subsequently undergo standard treatment with high dose chemotherapy followed by peripheral blood stem cell transplantation. In certain aspects, following or concurrent with the transplant, subjects receive an infusion of the expanded TFP T cells of the present invention. In an additional aspect, expanded cells are administered before or following surgery.

The dosage of the above treatments to be administered to a patient will vary with the precise nature of the condition being treated and the recipient of the treatment. The scaling of dosages for human administration can be performed according to art-accepted practices. The dose for alemtuzumab (CAMPATH®), for example, will generally be in the range 1 to about 100 mg for an adult patient, usually administered daily for a period between 1 and 30 days. The preferred daily dose is 1 to 10 mg per day although in some instances larger doses of up to 40 mg per day may be used (described, e.g., in U.S. Pat. No. 6,120,766).

In one embodiment, the TFP is introduced into T cells, e.g., using in vitro transcription, and the subject (e.g., human) receives an initial administration of TFP T cells of the invention, and one or more subsequent administrations of the TFP T cells of the invention, wherein the one or more subsequent administrations are administered less than 15 days, e.g., 14, 13, 12, 11, 10, 9, 8, 7, 6, 5, 4, 3, or 2 days after the previous administration. In one embodiment, more than one administration of the TFP T cells of the invention are administered to the subject (e.g., human) per week, e.g., 2, 3, or 4 administrations of the TFP T cells of the invention are administered per week. In one embodiment, the subject (e.g., human subject) receives more than one administration of the TFP T cells per week (e.g., 2, 3 or 4 administrations per week) (also referred to herein as a cycle), followed by a week of no TFP T cells administrations, and then one or more additional administration of the TFP T cells (e.g., more than one administration of the TFP T cells per week) is administered to the subject. In another embodiment, the subject (e.g., human subject) receives more than one cycle of TFP T cells, and the time between each cycle is less than 10, 9, 8, 7, 6, 5, 4, or 3 days. In one embodiment, the TFP T cells are administered every other day for 3 administrations per week. In one embodiment, the TFP T cells of the invention are administered for at least two, three, four, five, six, seven, eight or more weeks.

In one aspect, tumor-associated antigen TFP T cells are generated using lentiviral viral vectors, such as lentivirus. TFP-T cells generated that way will have stable TFP expression.

In one aspect, TFP T cells transiently express TFP vectors for 4, 5, 6, 7, 8, 9, 10, 11, 12, 13, 14, 15 days after transduction. Transient expression of TFPs can be effected by RNA TFP vector delivery. In one aspect, the TFP RNA is transduced into the T cell by electroporation.

A potential issue that can arise in patients being treated using transiently expressing TFP T cells (particularly with murine scFv bearing TFP T cells) is anaphylaxis after multiple treatments.

Without being bound by this theory, it is believed that such an anaphylactic response might be caused by a patient developing humoral anti-TFP response, i.e., anti-TFP antibodies having an anti-IgE isotype. It is thought that a patient's antibody producing cells undergo a class switch from IgG isotype (that does not cause anaphylaxis) to IgE isotype when there is a ten- to fourteen-day break in exposure to antigen.

If a patient is at high risk of generating an anti-TFP antibody response during the course of transient TFP therapy (such as those generated by RNA transductions), TFP T cell infusion breaks should not last more than ten to fourteen days.

Cytokine Release

Cytokine release syndrome is a form of systemic inflammatory response syndrome that arises as a complication of some diseases or infections, and is also an adverse effect of some monoclonal antibody drugs, as well as adoptive T cell therapies. TFP T cells can exhibit better killing activity than CAR-T cells. TFP T cells administered to a subject can exhibit better killing activity than CAR-T cells administered to a subject. This can be one of the advantages of TFP T cells over CAR-T cells. TFP T cells can exhibit less cytokine release CAR-T cells. A subject administered TFP T cells can exhibit less cytokine release than a subject administered CAR-T cells. This can be one of the advantages of TFP T cell therapies over CAR-T cell therapies. TFP T cells can exhibit similar or better killing activity than CAR-T cells and the TFP T cells can exhibit less cytokine release than the CAR-T cells. TFP T cells administered to a subject can exhibit similar or better killing activity than CAR-T cells administered to a subject and the subject can exhibit less cytokine release than a subject administered CAR-T cells. This can be one of the advantages of TFP T cell therapies over CAR-T cell therapies.

In some cases, the cytokine release of a treatment with TFP T cells is less than the cytokine release of a treatment with CAR-T cells. In some embodiments, the cytokine release of a treatment with TFP T cells is at least 10%, at least 20%, at least 30%, at least 40%, at least 50%, at least 60%, at least 70%, at least 80%, or at least 90% less than the cytokine release of a treatment with CAR-T cells. Various cytokines can be released less in the T cell treatment with TFP T cells than CAR-T cells. In some embodiments, the cytokine is IL-2, IFN-γ, IL-4, TNF-α, IL-6, IL-13, IL-5, IL-10, sCD137, GM-CSF, MIP-1α, MIP-1β, or a combination thereof. In some cases, the treatment with TFP T cells release less perforin, granzyme A, granzyme B, or a combination thereof, than the treatment with CAR-T cells. In some embodiments, the perforin, granzyme A, or granzyme B released in a treatment with TFP T cells is at least 10%, at least 20%, at least 30%, at least 40%, at least 50%, or at least 60% less than a treatment with CAR-T cells.

In some embodiments, for a given cytokine, at least 10% less amount of the given cytokine is released following treatment compared to an amount of the given cytokine of a mammal treated with a CAR-T cell comprising the same binding domain. In some embodiments, the given cytokine comprises one or more cytokines selected from the group consisting of IL-2, IFN-γ, IL-4, TNF-α, IL-6, IL-13, IL-5, IL-10, sCD137, GM-CSF, MIP-1α, MIP-1β, and any combination thereof.

The TFP T cells may exhibit similar or better activity in killing tumor cells than CAR-T cells. In some embodiments, a tumor growth in the mammal is inhibited such that a size of the tumor is at most 10%, at most 20%, at most 30%, at most 40%, at most 50%, or at most 60% of a size of a tumor in a mammal treated with T cells that do not express the TFP after at least 8 days of treatment, wherein the mammal treated with T cells expressing TFP and the mammal treated with T cells that do not express the TFP have the same tumor size before the treatment. In some embodiments, the tumor growth in the mammal is completely inhibited. In some embodiments, the tumor growth in the mammal is completely inhibited for at least 20 days, at least 30 days, at least 40 days, at least 50 days, at least 60 days, at least 70 days, at least 80 days, at least 90 days, at least 100 days, or more. In some embodiments, the population of T cells transduced with TFP kill similar amount of tumor cells compared to the CAR-T cells comprising the same binding domain.

The TFP T cells can exhibit different gene expression profile than cells that do not express TFP. In some cases, the TFP T cells may exhibit similar gene expression profiles than CAR-T cells. In some other cases, the TFP T cells may exhibit different gene expression profiles than CAR-T cells. In some embodiments, the population of T cells transduced with TFP have a different gene expression profile than the CAR-T cells comprising the same binding domain. In some embodiments, an expression level of a gene is different in the T cells transduced with the TFP than an expression level of the gene in the CAR-T cells comprising the same binding domain. In some embodiments, the gene has a function in antigen presentation, TCR signaling, homeostasis, metabolism, chemokine signaling, cytokine signaling, toll like receptor signaling, MIP and adhesion molecule signaling, or TNFR related signaling.

EXAMPLES

The invention is further described in detail by reference to the following experimental examples. These examples are provided for purposes of illustration only and are not intended to be limiting unless otherwise specified. Thus, the invention should in no way be construed as being limited to the following examples, but rather, should be construed to encompass any and all variations which become evident as a result of the teaching provided herein. Without further description, it is believed that one of ordinary skill in the art can, using the preceding description and the following illustrative examples, make and utilize the compounds of the present invention and practice the claimed methods. The following working examples specifically point out various aspects of the present invention and are not to be construed as limiting in any way the remainder of the disclosure.

The following are examples of methods and compositions of the invention. It is understood that various other embodiments may be practiced, given the general description provided herein.

The entire disclosures of all patent and non-patent publications cited herein are each incorporated by reference in their entireties for all purposes.

Example 1: Production of Anti-CD70 Nanobodies

A castrated naive male alpaca was immunized with the following 5 cancer cell lines:

1. Human KOPN-8 (human B cell precursor leukemia, DSMZ No. ACC 552).
2. Human HCC-1419 (human mammary gland, breast, epithelial, ATCC CRL-2326).
3. Human RERF-LC-KJ (adenocarcinoma, JCRB No. JCRB0081).
4. Human JVM-3 (chronic B-cell leukemia, DSMZ No. ACC 18), engineered to overexpress human EGFRvIII.
5. Human UACC-62 (human melanotic melanoma, skin, Addex Bio Cat. No. C0020003), engineered to overexpress a truncated human CD22 with domains 1-4 deleted.

Four rounds of injections were performed subcutaneously with 2e7 cells per cell line in Gerbu adjuvant P. The injection schedule was as follows: 3 weeks between the $1^{st}$ & $2^{nd}$ injections, 2 weeks between the $2^{nd}$ & $3^{rd}$ injections and 2 weeks between the $3^{rd}$ and $4^{th}$ injections. Four and 8 days after the $4^{th}$ injection 100 ml anticoagulated blood was collected for the preparation of peripheral blood lymphocytes (PBLs). The total RNA samples prepared from PBLs were then pooled and about 50 μg of the pool of total RNA was used as template for first strand cDNA synthesis with oligo dT primer. Using this cDNA, the VHH encoding sequences were amplified by PCR, digested with SAPI, and cloned into the SAPI site of the phagemid pMECS-GG vector. Electro-competent *E. coli* TG1 cells were transformed with the recombinant pMECS-GG phagemid resulting in a phage displayed VHH library of about $10^8$ independent transformants.

Panning of the Immune VHH Library Against Human CD70

Three rounds of panning were performed to isolate anti-CD70 VHH from the immune library. In all rounds, phage displaying VHHs were produced via helper phage infection of TG1 *E. coli* harboring VHH library phagemids and subsequent PEG/NaCl precipitation. In each round of panning ~$10^{12}$ phage particles were blocked in panning buffer (PBS+0.01% Tween20+4% w/v non-fat dry milk) and then incubated with streptavidin magnetic beads coated with biotinylated human IgG1 Fc (Acro, IG1-H82E2) to subtract non-specific phage. After subtraction, phage were incubated with streptavidin magnetic beads coated with biotinylated human CD70 (Acro, CDL-H82Q9) for at least 1 hour at room temperature. After washing, phage were eluted from the magnetic beads and used to infect *E. coli* to propagate the phagemids and produce phage for the next round of panning. The concentration of human CD70 was varied in each round as follows:

Round 1: 100 nM
Round 2: 100 nM
Round 3: 50 nM
Round 2a: 0.1 nM
Round 3a: 0.1 nM plus overnight off-rate competition with 100 nM human CD70 in solution After the last round of panning recovered phage were used to infect SS320 *E. coli*. The SS320 strain allows for expression of soluble his-tagged VHH which can be used in ELISAs to identify target-binding clones.

Recombinant Human CD70 ELISA to Identify Anti-CD70 VHH

Individual SS320 *E. coli* colonies harboring monoclonal phagemids were picked into 96-well culture plates and grown overnight at 37° C. in a shaking incubator. The following day cultures were reset to ~0.05 $OD_{600}$ in a 200 μL volume and grown until mid-log phase ($0.5<OD_{600}<0.8$). At this point, expression of VHH-his was induced by the addition of IPTG to a final concentration of 1 mM. TritonX-100 detergent was also added to the cultures to a final concentration of 1% to facilitate secretion of VHH-His into the culture supernatant. Plates were grown overnight at 30° C. in a shaking incubator. The next day plates were spun down and the supernatant containing secreted VHH-His was applied to pre-blocked ELISA plates coated with 1 μg/mL human CD70. Plates were incubated for at least 1 hour at room temperature. Next, plates were washed 3× with PBST (PBS+0.01% Tween20), secondary antibody (anti-His-HRP) was applied, and the plates incubated for an additional 30 minutes at room temperature. Following 3×PBST washes TMB substrate was applied to the plates and the reaction was allowed to proceed for 1-5 minutes before 1M HCl was applied as a stop solution. Immediately following application of the stop solution the absorbance at 450 nm ($OD_{450}$) of each well was measured on a spectrophotometer. Wells with $OD_{450}$ greater than 3 times the background signal were identified as positive binders. Positive binders sent to Genewiz for sanger sequencing to identify the VHH sequence and unique clones were retained for further characterization. At least 87 distinct binders were identified. The sequences of these binders are provided in Table 5. Humanized versions of R3P15F6, R3P3H12, R3aP3E8, R3aP9D10, and R3P5A1 have also been generated. Humanized versions of R3P15F6 have SEQ ID NOs 728-731.

```
Humanized R3P15F6
                                        (SEQ ID NO: 728)
EVQLVESGGGLVQPGGSLRLSCAASGFTLDKYAMGWFRQAPGKEL

EGVSCITSSSGVVYYADSVKGRFTISRDNAKNTLYLQMNSLRPE

DTAVYYCAAAGPPDDCSVPGYYGLNYWGQGTQVTVSS

                                        (SEQ ID NO: 729)
EVQLVESGGGLVQPGGSLRLSCAASGFTLDKYAMGWFRQAPGKEL

EGVSCITSSSGVVYYADSVKGRFTISRDNAKNTLFLQMNSLRPE

DTAVYYCAAAGPPDDCSVPGYYGLNYWGQGTQVTVSS

                                        (SEQ ID NO: 730)
EVQLVESGGGLVQPGGSLRLSCAASGFTLDKYAMGWFRQAPGKEL

EGVSCITSSSGVVKYADSVKGRFTISRDNAKNTLFLQMNSLRPE

DTAVYYCAAAGPPDDCSVPGYYGLNYWGQGTQVTVSS

                                        (SEQ ID NO: 731)
EVQLVESGGGLVQPGGSLRLSCAASGFTLDKYAMGWFRQAPGKEL

EGVSCITSSSGVVKYADSVKGRFTISRDNTKNTLFLQMNSLRPE
```

-continued

DTAVYYCAAAGPPDDCSVPGYYGLNYWGQGTQVTVSS

Humanized versions of R3P3H12 have SEQ ID NOs 732-734.

(SEQ ID NO: 732)

EVQLVESGGGLVQPGGSLRLSCAASGSIFDIVRMSWYRQAPGKQR

ELVSIITSGGATYYADSVKGRFTISRDNAKNALYLQMNSLRPED

TAVYYCNMESVRYRNYWGQGTQVTVSS (SEQ ID NO: 733)

EVQLVESGGGLVQPGGSLRLSCAASGSIFDIVRMSWYRQAPGNQR

ELVSIITSGGATYYADSVKGRFTISRDNAKNALYLQMNSLRPEDT

AVYYCNMESVRYRNYWGQGTQVTVSS (SEQ ID NO: 734)

EVQLVESGGGLVQPGGSLRLSCAASGSIFDIVRMSWYRQAPGNQR

ELVSIITSGGATYYADSVKGRFTISRDNAWKALYLQMNSLRPED

TAVYYCNMESVRYRNYWGQGTQVTVSS

Humanized versions of R3aP3E8 have SEQ ID NOs 735-737.

(SEQ ID NO: 735)

EVQLVESGGGLVQPGGSLRLSCAASGFTLEHYSMSWFRQAPGKDL

EGVSCITSSGGIPYYADSVKGRFTISRDNAKNTLYLQMNSLKPE

DTAVYYCGAATPDDDCSVPGHYGLNYWGQGTLVTVSS (SEQ ID NO: 736)

EVQLVESGGGLVQPGGSLRLSCAASGFTLEHYSMGWFRQAPGKDL

EGVSCITSSGGIPYYADSVKGRFTISRDNAKNTLYLQMNSLKPE

DTAVYYCGAATPDDDCSVPGHYGLNYWGQGTLVTVSS (SEQ ID NO: 737)

EVQLVESGGGLVQPGGSLRLSCAASGFTLEHYSMGWFRQAPGKDL

EGVSCITSSGGIPKYADSVKGRFTISRDNAKNTLYLQMNSLKPE

DTAVYYCGAATPDDDCSVPGHYGLNYWGQGTLVTVSS

Humanized versions of R3aP9D10 have SEQ ID NOs 738-740.

(SEQ ID NO: 738)

EVQLLESGGGLVQPGGSLRLSCAAPGFTFDAYAMSWFRQAPGKER

EGVSCLSPSDGSTYYADSVKGRFTISRDNSKNTLYLQMNSLRPE

DTAVYYCATPSWCSLKADFGSWGQGTLVTVSS (SEQ ID NO: 739)

EVQLLESGGGLVQPGGSLRLSCAAPGFTFDAYAMGWFRQAPGKER

EGVSCLSPSDGSTYYADSVKGRFTISRDNSKNTLYLQMNSLRPE

DTAVYYCATPSWCSLKADFGSWGQGTLVTVSS (SEQ ID NO: 740)

EVQLLESGGGLVQPGGSLRLSCAAPGFTFDAYAMGWFRQAPGKER

EGVSCLSPSDGSTYYADSVKGRFTISRDNAKNTLYLQMNSLRPE

DTAVYYCATPSWCSLKADFGSWGQGTLVTVSS

Humanized versions of R3P5A1 have SEQ ID NOs 741-743.

(SEQ ID NO: 741)

EVQLVESGGGLVQPGGSLRLSCAASGSIFSATRMSWYRQAPGKQR

ELVSIVTSGGRTYYADSVKGRFTISRDNAKNTLYLQMNSLRPED

TAVYYCKFERYDYVNYWGQGTLVTVSS

-continued (SEQ ID NO: 742)

EVQLVESGGGLVQPGGSLRLSCAASGSIFSATRMEWYRQAPGKQR

ELVSIVTSGGRTYYADSVKGRFTISRDNAKNTLYLQMNSLRPED

TAVYYCKFERYDYVNYWGQGTLVTVSS (SEQ ID NO: 743)

EVQLVESGGGLVQPGGSLRLSCAASGSIFSATRMEWYRQAPGKQR

ELVSIVTSGGRTYYADSVKGRFTISRDNAKNTLYLQMNNLRPED

TAVYYCKFERYDYVNYWGQGTLVTVSS

Example 2: Characterization of Anti-CD70 Nanobodies

Cell Binding ELISA with Unique Anti-CD70 VHH

Binders R3P2G8 VHH, R3P3H12 VHH, R3aP9D10 VHH, R3aP3E8 VHH, R2P14A12 VHH, and R3P5A1 VHH were further characterized by ELISA. SS320 *E. coli* harboring unique VHH phagemids were grown overnight at 37° C. in a shaking incubator. The following day cultures were reset to ~0.05 OD600 in a 1-3 mL volume and grown until mid-log phase (0.5<OD600<0.8). At this point, expression of VHH-his for secretion into the *E. coli* periplasm was induced by the addition of IPTG to a final concentration of 1 mM. Cultures were then grown overnight at 30° C. in a shaking incubator. The next day, cultures were spun down, the pellet retained, and periplasmic proteins extracted using BugBuster Master Mix (EMD Millipore, 71456) via the manufacturers' protocol. VHH-his proteins were purified from the periplasmic extract using Ni-NTA magnetic beads (Promeaga, V8500) and the manufacturers' purification protocol. After purification VHH-his protein concentration was estimated via Bradford or BCA protein quantification assays or by NanoDrop A280 measurement.

A cell binding ELISA was carried out to determine whether the anti-CD70 VHHs could recognize the antigen on cells. ~500 nM each VHH-his was diluted in blocking buffer (PBS+0.01% Tween20+2% non-fat dry milk) and added to wells containing 100,000-200,000 pre-blocked CHO-CD70 cells (high CD70 expression), JVM3 cells (medium-low CD70 expression), wild type CHO cells (negative control), HL60 cells (negative control). The plate was incubated for 1 hour at room temperature with agitation. After incubation cells were washed 3 times by spinning down and dumping of the supernatant followed by addition of PBST. Subsequently, secondary antibody was applied (anti-His-HRP) and the mixture incubated for 30 minutes. After 3 more washes TMB substrate was applied to the plates and the reaction was allowed to proceed for 1-5 minutes before 1M HCl was applied as a stop solution. Immediately following application of the stop solution the absorbance at 450 nm ($OD_{450}$) of each well was measured on a spectrophotometer. The results are shown in FIG. 1. As is shown, each of the R3P2G8 VHH, R3P3H12 VHH, R3aP9D10 VHH, R3aP3E8 VHH, R2P14A12 VHH, and R3P5A1 VHH binders identified, in addition to the 1F6 and 41D12 scFv CD70 binders, showed the highest binding to CHO-CD70 cells (high CD70 expression) and showed little binding to type CHO cells (negative control) and HL60 cells (negative control).

Octet Binding Assay

Bio-layer interferometry was used to measure the binding affinity of CD70 to CD70-targeted antibodies 41D12, R3P3H12, R3P5A1, R3aP3E8, and R3aP9D10, and human CD27 fused to human Fc domain (CD27-Fc; Acro Biosystems cat. CD7-h5254). N-terminally biotinylated CD70 (residues 39-193) (Acro Biosystems cat. CDL-H82Q9) was diluted in Octet Buffer [PBS containing 0.02% Tween20 (vol./vol.) and 0.1% bovine serum albumin (wt./vol.)] to a final concentration of 3 μg/mL and immobilized on Pall ForteBio Dip and Read™ Streptavidin Biosensors (Pall ForteBio cat. 185019) to a final biolayer thickness of 0.5-1.0 nm. Following CD70 immobilization, biosensors were immersed in Octet Buffer to remove unbound, biotinylated CD70 and to establish a flat baseline sensor signal. CD70-loaded Biosensors were then transferred to Octet buffer containing 400 nM of CD27-Fc or αCD70 antibody and association was monitored for 5 minutes at 30° C. whilst agitating at 1,000 RPM. An scFv fragment derived from humanized llama αCD70 antibody 41D12 and fused to human Fc (41D12-Fc) served as a positive control for CD70 binding and an αLysozyme single-domain camelid antibody (clone D2-L19) was used as a negative control. CD27-Fc or αCD70 antibody dissociation was initiated by transferring sensors to Octet buffer and monitored for 5 minutes. Data were analyzed using ForteBio Data Analysis Suite 9.0. The observed association ($k_{on}$) and dissociation ($k_{off}$) rates for the binding of single-domain antibodies to CD70 were determined using a 1:1 curve fitting model to obtain, in all cases, $R^2 \geq 0.95$. Values of the equilibrium dissociation constant for binding to CD70, $K_D$, were determined from the ratio of $k_{off}$ and $k_{on}$. The binding of 41D12-Fc and CD27-Fc were fitted to a 2:1 model to accommodate the bivalence of the fused Fc domains, and $R^2 \geq 0.95$ was achieved in all cases.

Figure 2:
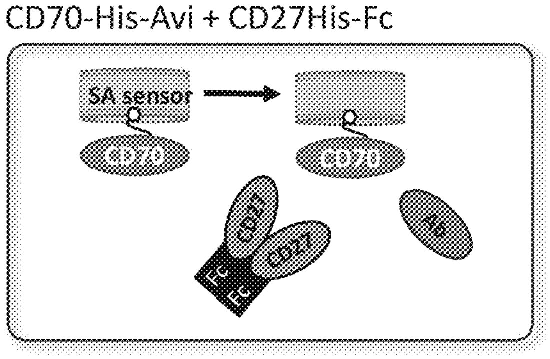
FIG. 2 shows the results of an octet binding assay for determining the affinity of each of the anti-CD70 VHHs and scFvs shown for CD70.
Figure 2:
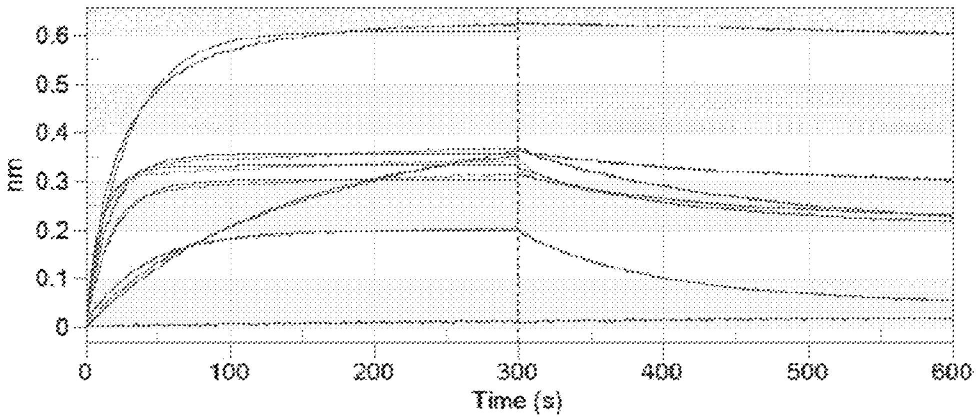

The results shown in FIG. 2 demonstrate high affinity of each of the newly generated anti-CD70 antibodies for CD70.

Epitope Bin Classification of Anti-CD70 Nanobodies

Bio-layer interferometry was used to classify CD70-targeted antibodies 1F6, 41D12, R3AP3E8, R3AP9D10, R3P3H12, and R3P5A1 and human CD27 fused to human Fc domain (CD27-Fc; Acro Biosystems cat. CD7-h5254) into epitope bins based on pairwise competition for CD70 binding. All steps were performed at 30° C. while agitating at 1,000 RPM. N-terminally biotinylated CD70 (residues 39-193) (Acro Biosystems cat. CDL-H82Q9) was diluted in Octet Buffer [PBS containing 0.02% Tween20 (vol./vol.) and 0.1% bovine serum albumin (wt./vol.)] to a final concentration of 3 μg/mL and immobilized on Pall ForteBio Dip and Read™ Streptavidin Biosensors (Pall ForteBio cat. 185019) to a final biolayer thickness of 0.5-1.0 nm. CD70-loaded sensors were transferred to Octet Buffer to establish a stable post-loading baseline. Association and full saturation of CD70 was achieved by using 400 nM of Ab1 solutions, comprised of individual αCD70 VHHs, individual human Fc fusions to αCD70 scFv fragments (41D12-Fc and 1F6-Fc), or CD27-Fc in Octet Buffer. This step is called the saturation step. Thereafter, CD70 biosensors were washed for 10 seconds using Octet Buffer and biosensors were transferred to Octet Buffer containing both 200 nM of the same antibody or receptor used in the saturation step and a singular Ab2 (αCD70 VHHs, scFvs 41D12 and 1F6, or CD27-Fc) at 200 nM in Octet Buffer. This step is called the competition step. All possible Ab1 identities in the saturation step were screened against all possible Ab2 combinations in the competition step.

Epitope binning pairs were identified based on a CD70 binding signal threshold for the competition step. The signal threshold was defined as the largest self-blocking CD70 binding signal observed when the same binder is used for saturation and competition steps. Non-competitive Ab1/Ab2 pairs were sorted into unique epitope bins when neither Ab1 nor Ab2 blocked CD70 binding during the competition step and produced a signal >self-blocking threshold. Competitive Ab1/Ab2 pairs enforced mutual blockade of CD70 binding signal by generating values ≤the self-blocking threshold. Unidirectional Ab1/Ab2 binning pairs were defined as pairs that exhibited asymmetric competition for CD70 binding based on comparative antigen affinity. Data were analyzed by Pall ForteBio Data Analysis 9.0 software to generate an epitope binning matrix and identify binning, non-binning, and unidirectional pairs.

Figure 3:
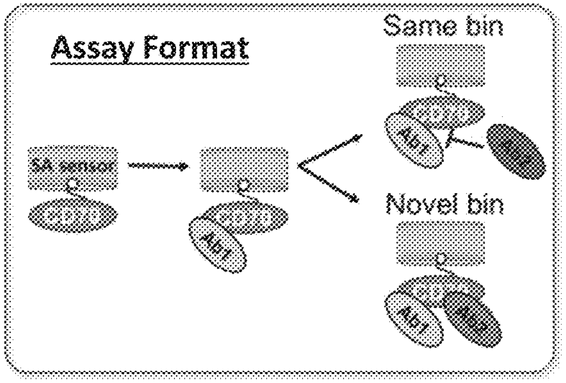
FIG. 3 shows the results of epitope binning assay for determining the binning of each of the anti-CD70 VHHs and scFvs shown and for CD27.
Figure 3:
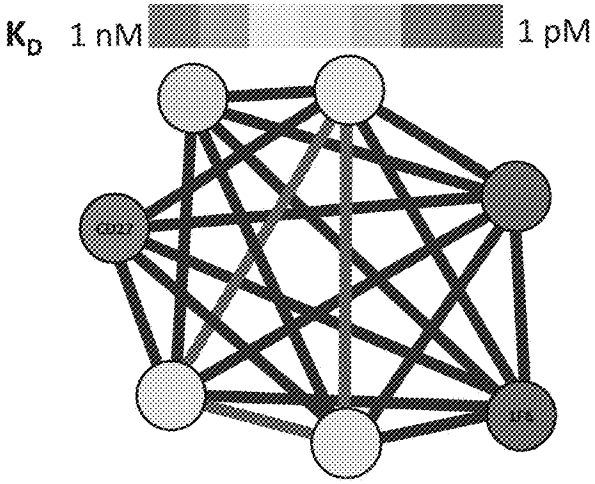
Figure 3:
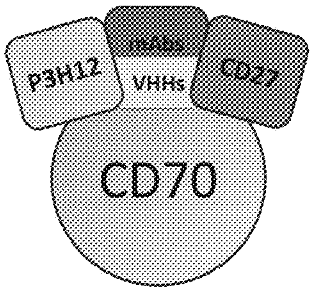

The results presented herein and shown in FIG. 3 demonstrate that each of the anti-CD70 antibodies 1F6, 41D12, R3AP3E8, R3AP9D10, R3P3H12, and R3P5A1 bin together to the same epitopic region of CD70 and all of the anti-CD70 antibodies bin with CD27 except for R3P3H12. Antibody 41D12 exhibits unidirectional displacement of antibody 1F6. Both 41D12 and 1F6 displace or block binding of CD27 and antibodies R3AP3E8, R3AP9D10, R3P3H12, and R3P5A1 to CD70.

CD27 Competition Assay

Figure 4:
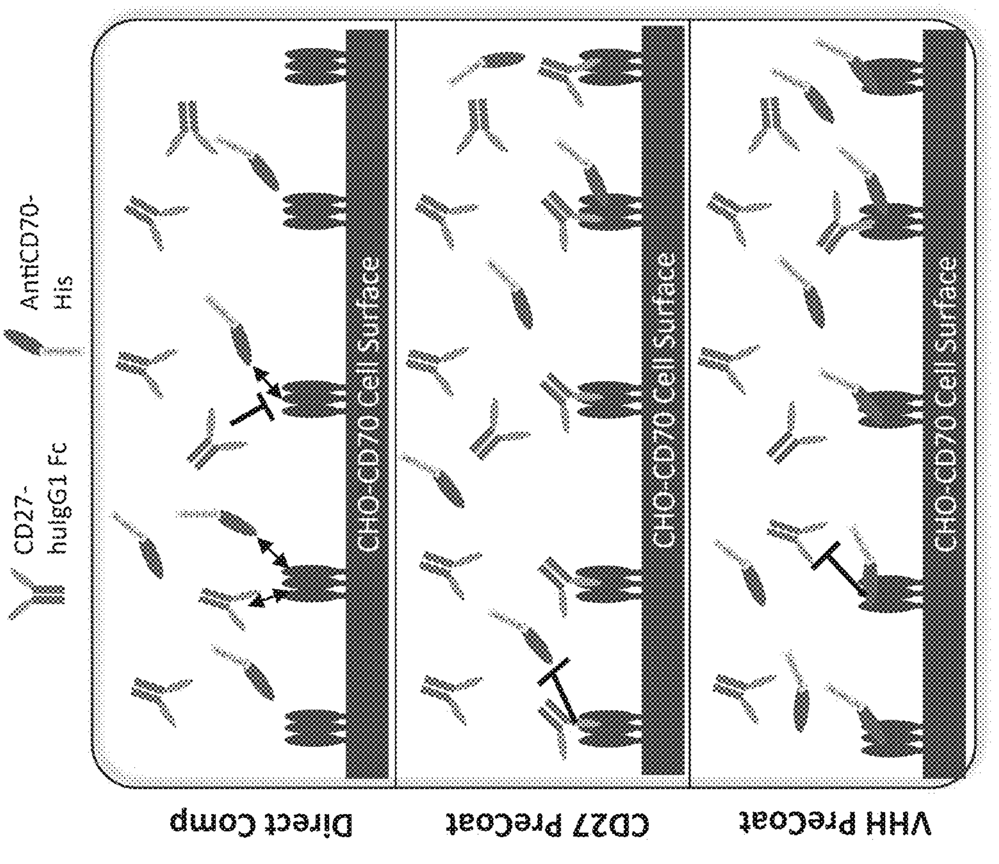
FIG. 4 is a schematic illustration of the competition assay described in Example 2.
Figure 5A:
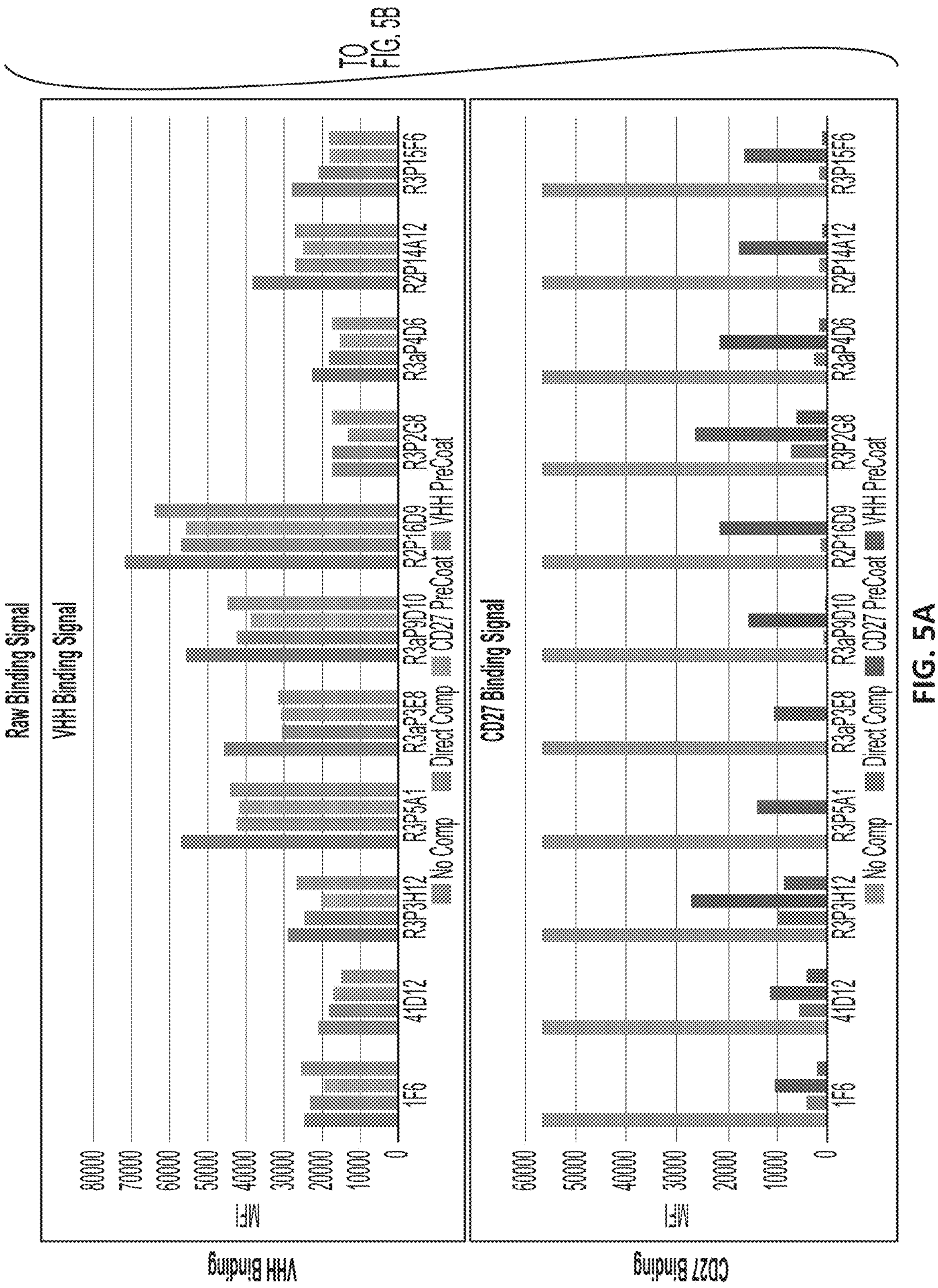
FIG. 5 is a graphical representation of the competition assay shown in FIG. 4 for assessing competition of the anti-CD70 VHHs and scFvs shown with CD27 for binding to CD70.
Figure 5B:
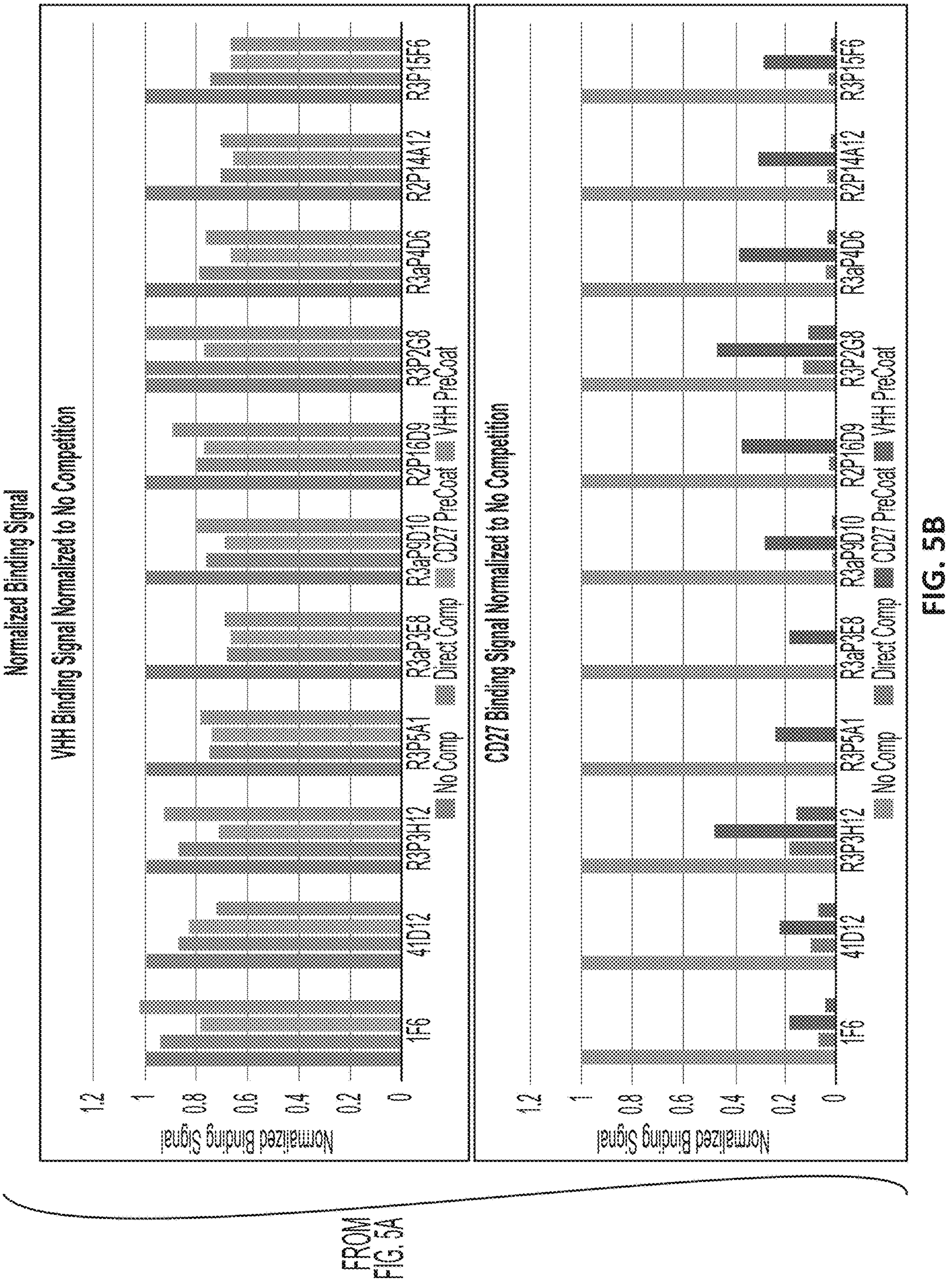
Figures 1, 6A:
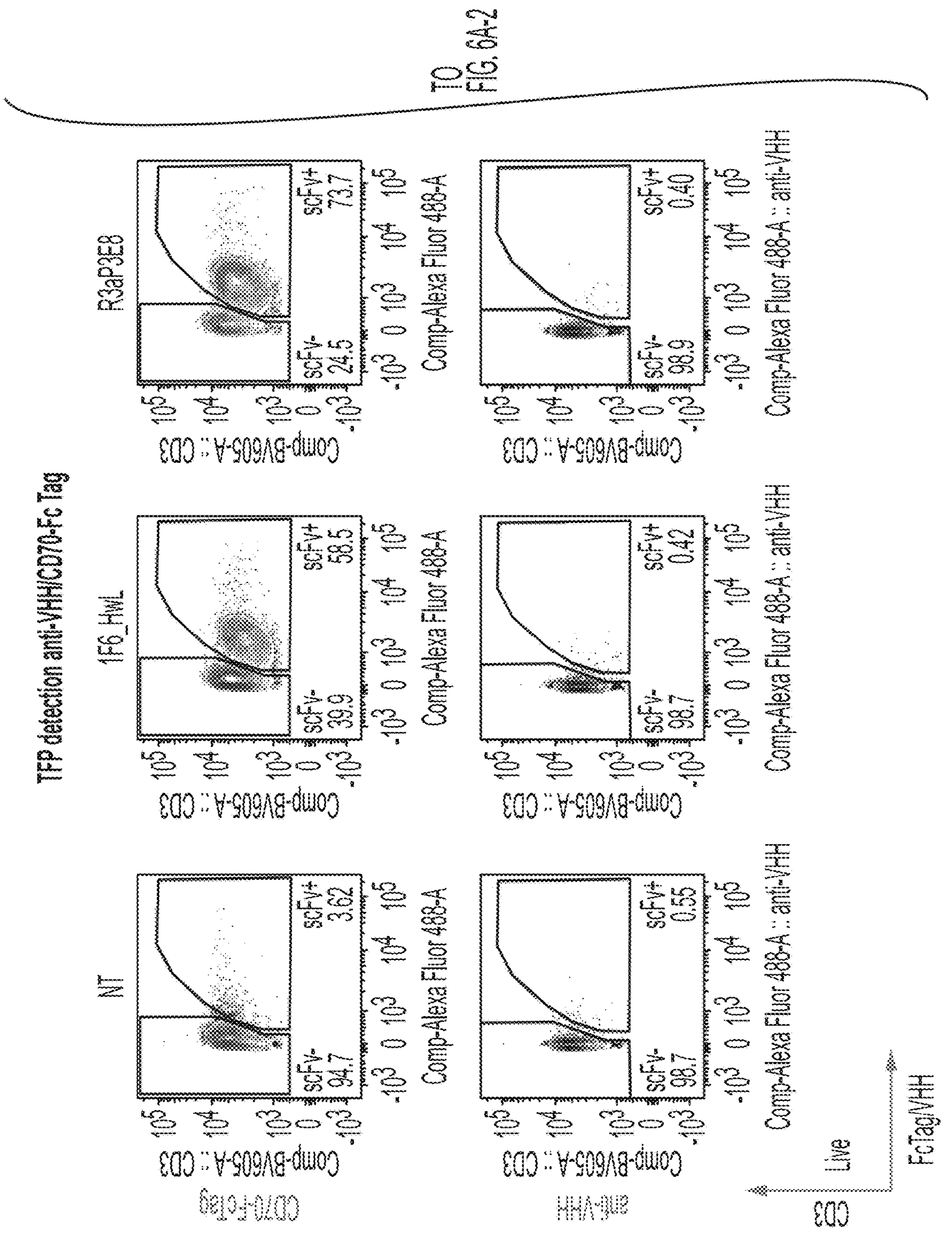
FIGS. 6A-6C is a graphical representation of flow cytometry data detecting cell surface TFP expression by staining with an anti-VHH antibody and a CD70-Fc Tag in T cells transduced with TFPs having the binders shown or untransduced control T cells.
Figures 2, 6A:
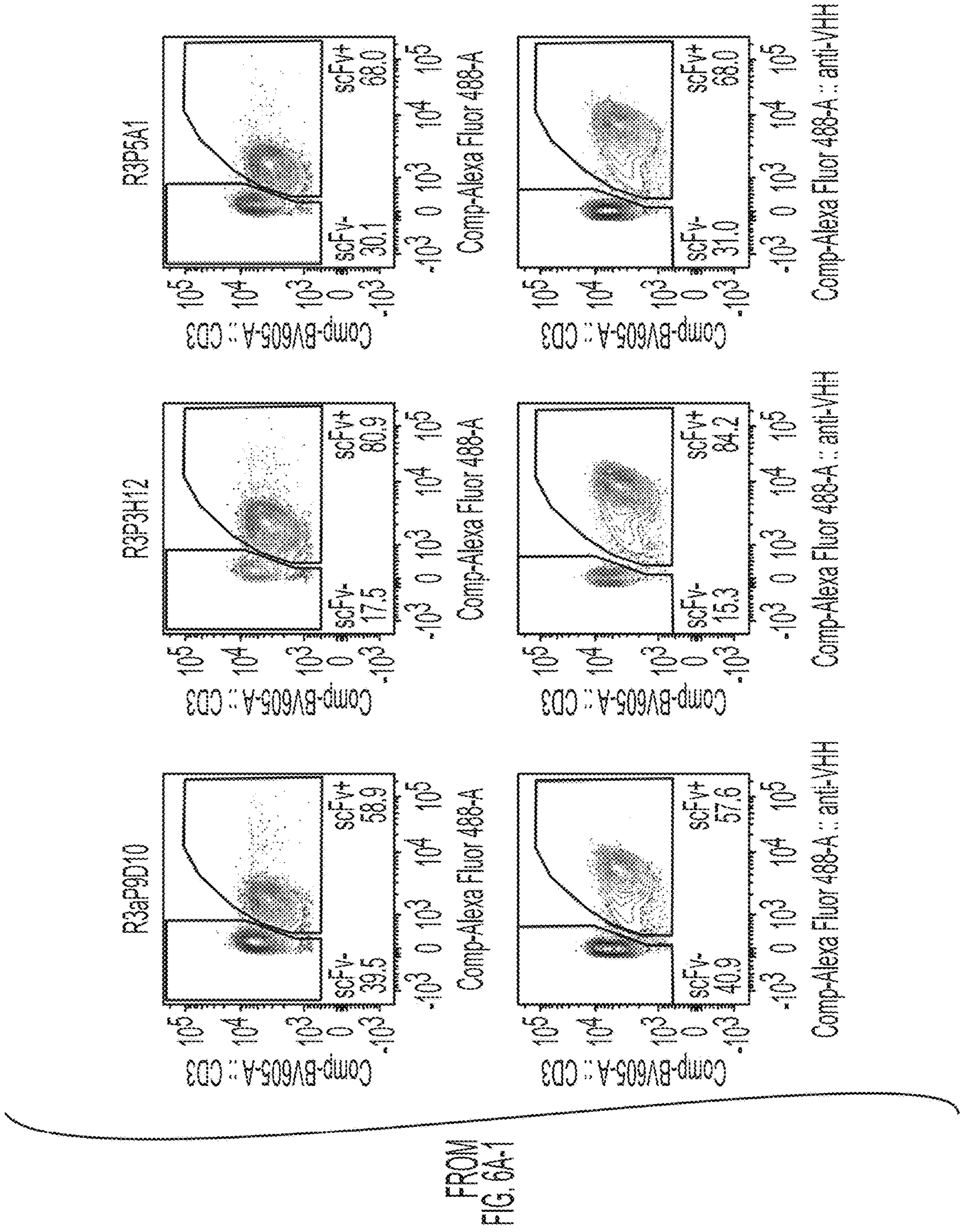
Figure 6B:
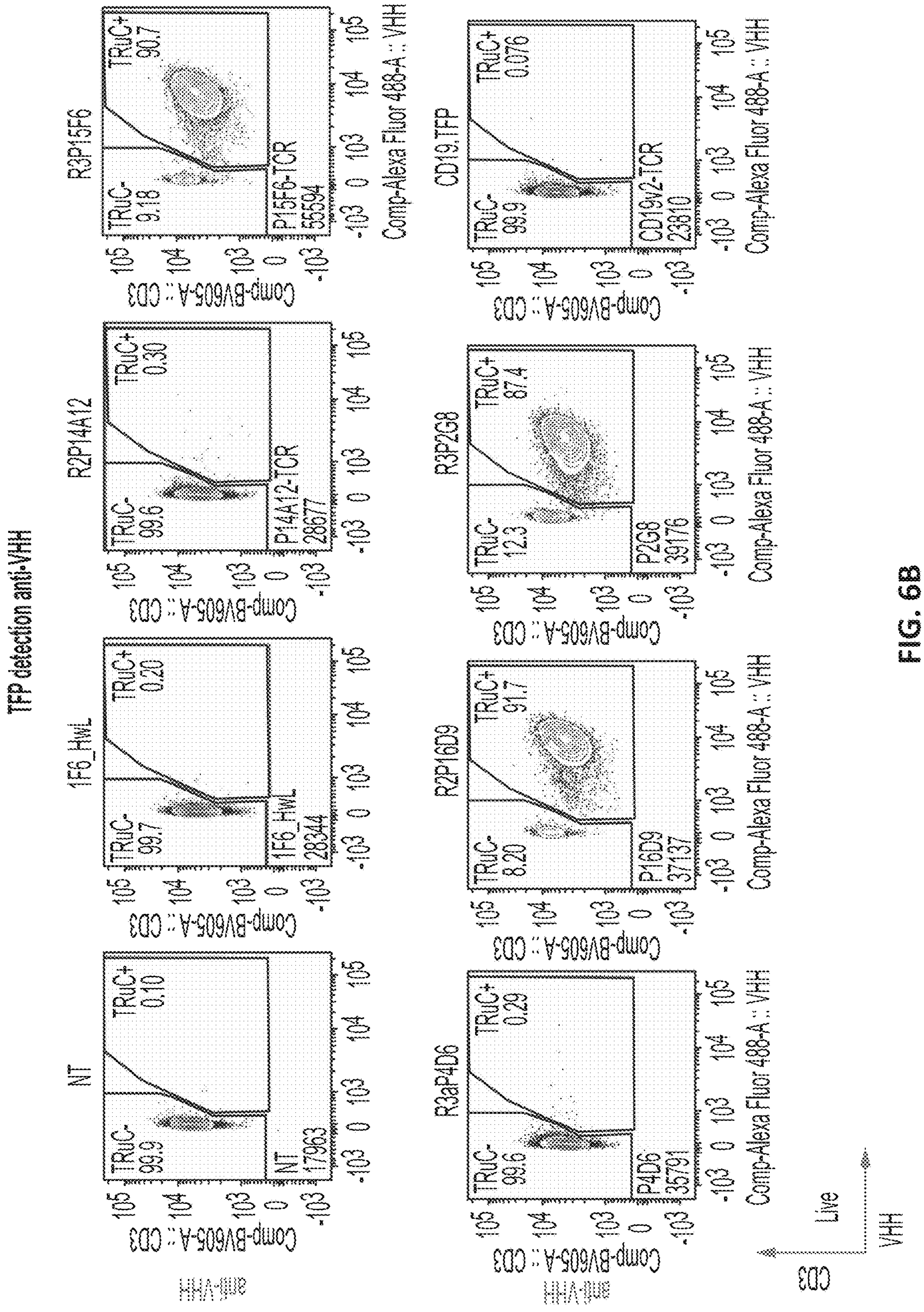
Figure 6C:
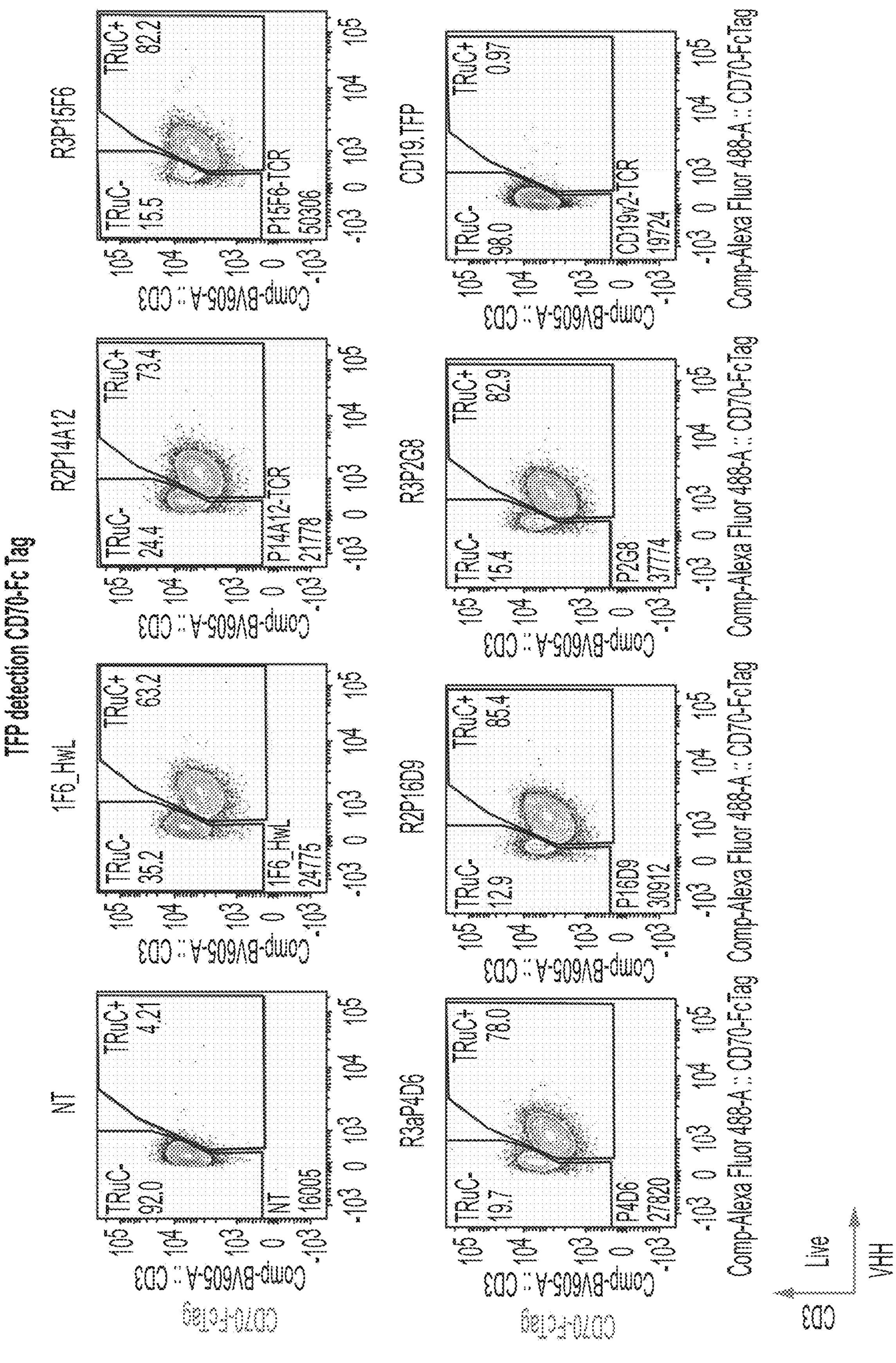
Figures 1, 7A:
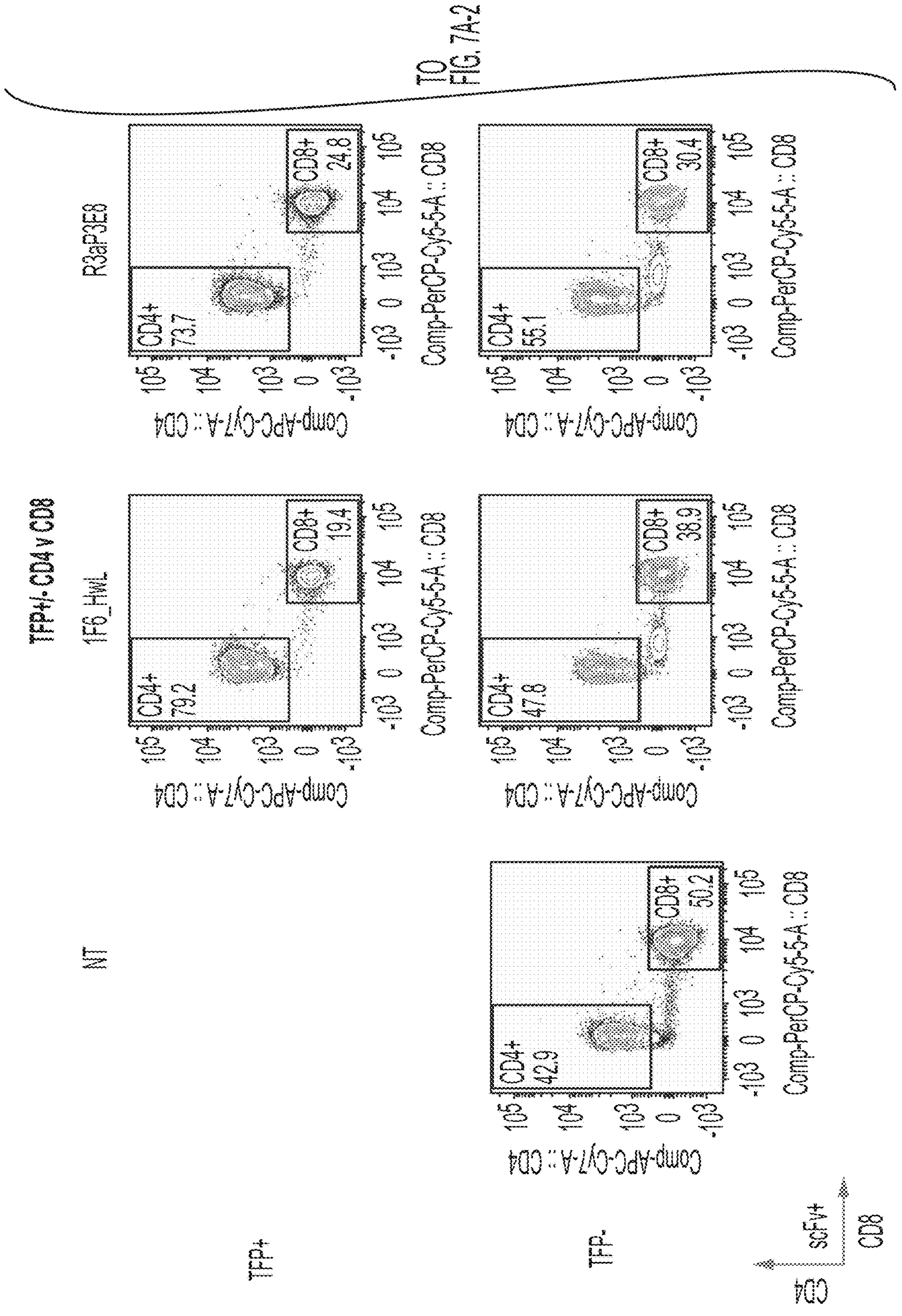
FIGS. 7A-7C is a graphical representation of flow cytometry data detecting CD4+ and CD8+ positivity in T cells transduced with TFPs having the binders shown or untransduced control T cells.
Figures 2, 7A:
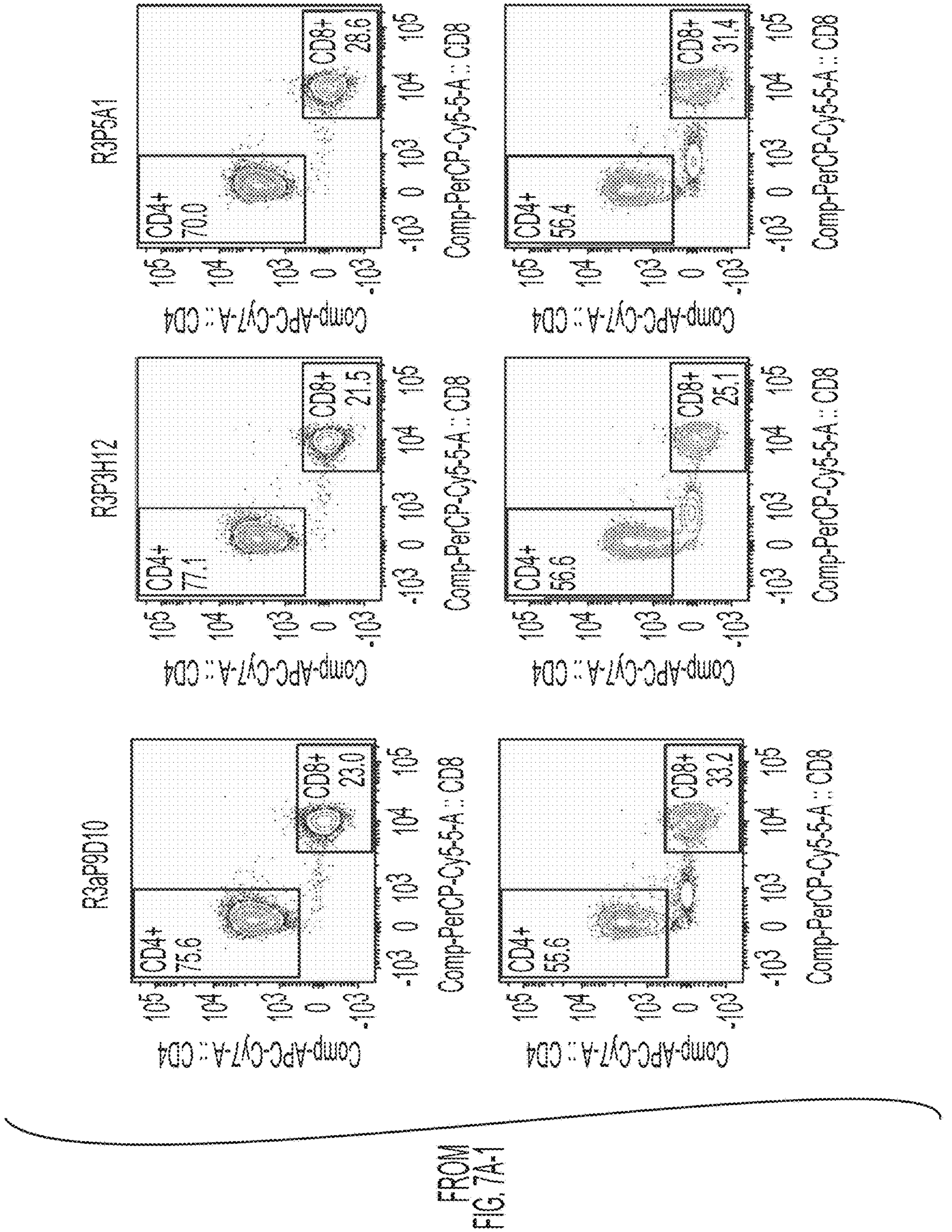
Figure 7B:
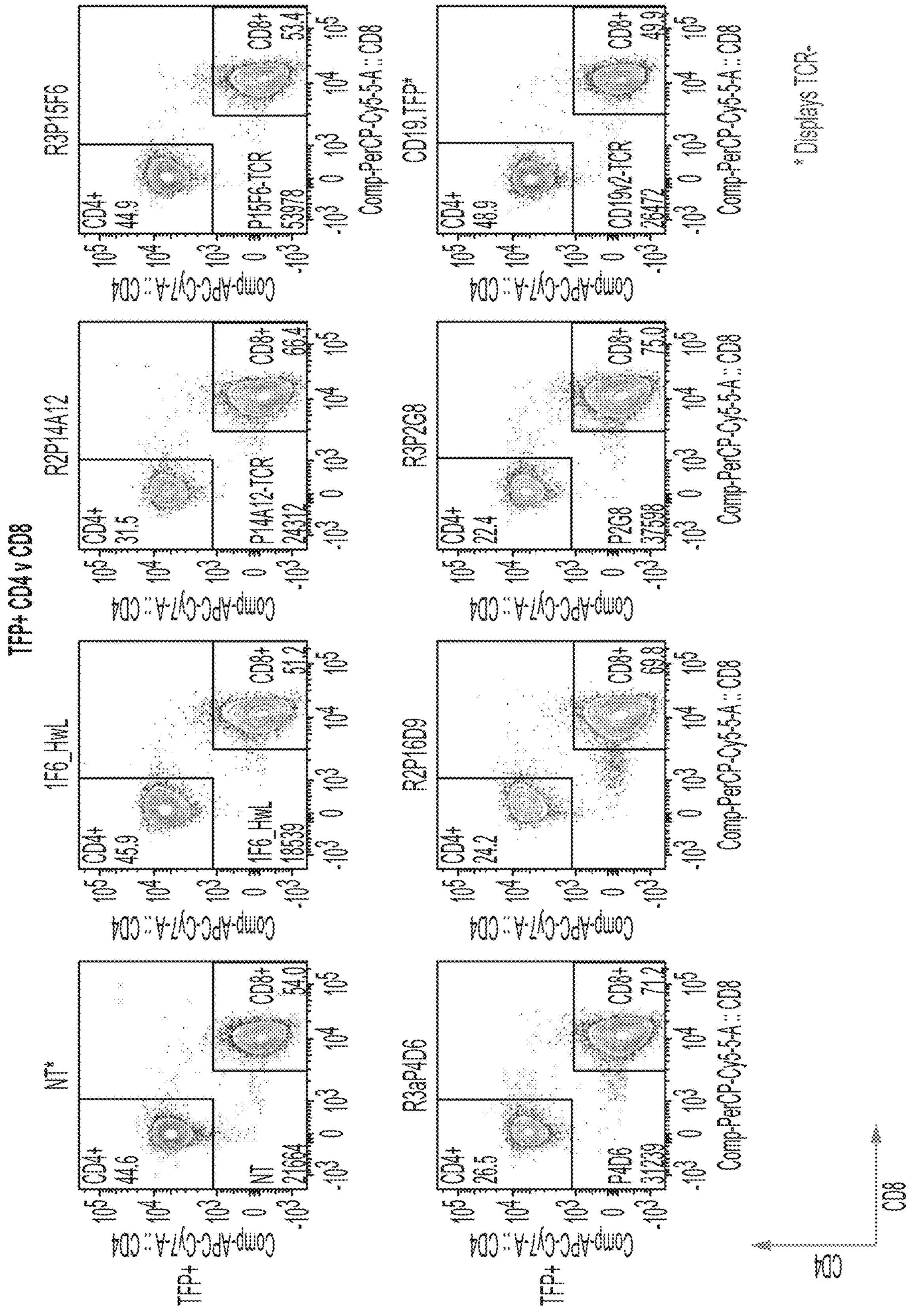
Figure 7C:
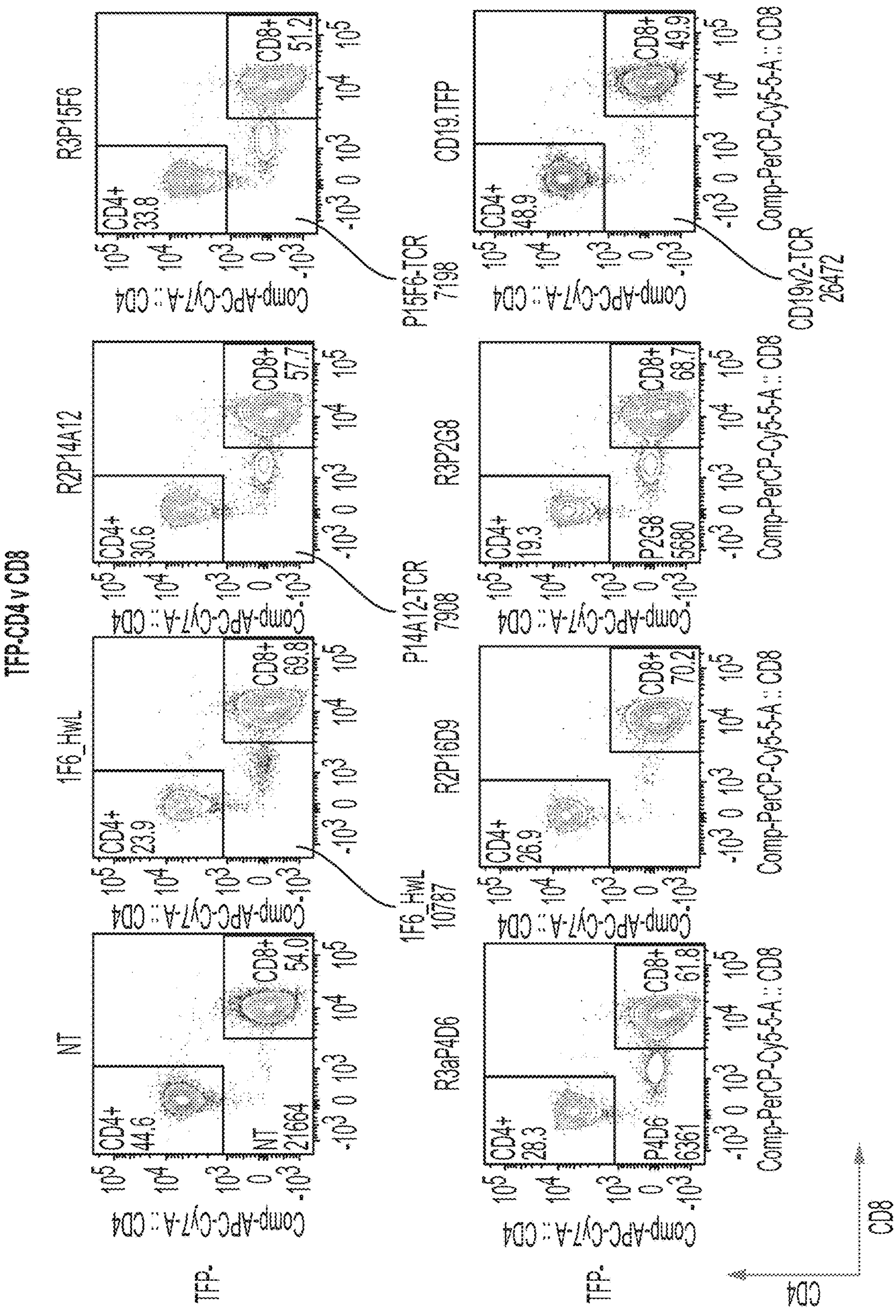

A CD27 competition assay was done by contacting anti-CD70 antibodies (1F6, 4D12, R3P2G8, R3P3H12, R2P14A12, R3P15F6, R3aP9D10, R3aP4D6, R2P16D9, or R3P5A1)

with cell-surface attached CD70 expressing CHO cells in a variety of configurations with and without competition with CD27-Fc. The experimental design is illustrated in FIG. 4. In the first condition, anti-CD70 or CD27Fc were each applied directly to the CHO cells without competition from the other (no competition). In the second condition (direct competition), the anti-CD70 antibodies were mixed with CD27-Fc, and the mixture was then applied to the cells. In the third condition, the CHO cells were first contacted with CD27-Fc (i.e., precoated), washed, and the mixture of anti-CD70 antibodies and CD27-Fc was then applied. In the fourth condition, the CHO cells were first contacted with the anti-CD70 antibody washed, and the mixture of anti-CD70 antibodies and CD27-Fc was then applied. The binding signal was then measured. The results presented in FIG. 5 demonstrate that the anti-CD70 antibodies outcompete CD27 for CD70 binding in all conditions tested.

Example 3: TFP Constructs

Anti-CD70 TFP constructs were engineered by cloning the CD70 $V_{HH}$ domains (or scFv domains) DNA fragment linked to a CD3 or TCR DNA fragment by either a DNA sequence encoding a short linker (SL): AAAGGGGSGGGGSGGGGSLE (SEQ ID NO:692) or a long linker (LL): AAAIEVMYPPPYLGGGGSGGGGSGGGGSLE (SEQ ID NO:693) into the pLRPO vector. Various other vector may be used to generate fusion protein constructs. Examples of the anti-CD70 TFP constructs generated include anti-CD70-linker-human CD3ε chain (including extracellular, transmembrane, and intracellular domains), with the anti-CD70 antigen binding domain being 1F6 scFv, 41D12 scFv, R3P2G8 VHH, R3P3G1 VHH, R3P3H12 VHH, R2P14A12 VHH, R3P15F6 VHH, R3aP3E8 VHH, R3aP9D10 VHH, R3aP4D6 VHH, R2P16D9 VHH, and R3P5A1 VHH.

Source of TCR Subunits

Subunits of the human T Cell Receptor (TCR) complex all contain an extracellular domain and a transmembrane domain. The CD3 epsilon, CD3 delta, and CD3 gamma subunits have an intracellular domain. A human TCR complex contains the CD3-epsilon polypeptide, the CD3-gamma poly peptide, the CD3-delta polypeptide, and the TCR alpha chain polypeptide and the TCR beta chain polypeptide or the TCR delta chain polypeptide and the TCR gamma chain polypeptide. TCR alpha, TCR beta, TCR gamma, and TCR delta recruit the CD3 zeta polypeptide. The human CD3-epsilon polypeptide canonical sequence is Uniprot Accession No. P07766. The human CD3-gamma polypeptide canonical sequence is Uniprot Accession No. P09693. The human CD3-delta polypeptide canonical sequence is Uniprot Accession No. P043234. The human CD3-zeta polypeptide canonical sequence is Uniprot Accession No. P20963. The human TCR alpha chain canonical sequence is Uniprot Accession No. Q6ISU1. The human TCR beta chain C region canonical sequence is Uniprot Accession No. P01850, a human TCR beta chain V region sequence is P04435.

The human CD3-epsilon polypeptide canonical sequence is:

(SEQ ID NO: 694)
MQSGTHWRVLGLCLLSVGVWGQDGNEEMGGITQTPYKVSISGTTVILTCPQYPGSEILWQH

NDKNIGGDEDDKNIGSDEDHLSLKEFSELEQSGYYVCYPRGSKPEDANFYLYLRARVCENC

MEMDVMSVATIVIVDICITGGLLLLVYYWSKNRKAKAKPVTRGAGAGGRQRGQNKERPPPV

PNPDYEPIRKGQRDLYSGLNQRRI.

The mature human CD3-epsilon polypeptide sequence is:

(SEQ ID NO: 1235)
DGNEEMGGITQTPYKVSISGTTVILTCPQYPGSEILWQHNDKNIGGDEDDKNIGSDEDHLS

LKEFSELEQSGYYVCYPRGSKPEDANFYLYLRARVCENCMEMDVMSVATIVIVDICITGGL

LLLVYYWSKNRKAKAKPVTRGAGAGGRQRGQNKERPPPVPNPDYEPIRKGQRDLYSGLNQR

RI

The signal peptide of human CD3ε is:

(SEQ ID NO: 695)
MQSGTHWRVLGLCLLSVGVWGQ.

The extracellular domain of human CD3ε is:

(SEQ ID NO: 696)
DGNEEMGGITQTPYKVSISGTTVILTCPQYPGSEILWQHNDKNIGGDEDDKNIGSDEDHLS

LKEFSELEQSGYYVCYPRGSKPEDANFYLYLRARVCENCMEMD.

The transmembrane domain of human CD3ε is:

(SEQ ID NO: 697)
VMSVATIVIVDICITGGLLLLVYYWS.

The intracellular domain of human CD3ε is:

(SEQ ID NO: 698)
KNRKAKAKPVTRGAGAGGRQRGQNKERPPPVPNPDYEPIRKGQRDLYSGLNQRRI.

The human CD3-gamma polypeptide canonical sequence is:

(SEQ ID NO: 699)
MEQGKGLAVLILAIILLQGTLAQSIKGNHLVKVYDYQEDGSVLLTCDAEAKNITWFKDGKM

IGFLTEDKKKWNLGSNAKDPRGMYQCKGSQNKSKPLQVYYRMCQNCIELNAATISGFLFAE

IVSIFVLAVGVYFIAGQDGVRQSRASDKQTLLPNDQLYQPLKDREDDQYSHLQGNQLRRN.

The mature human CD3-gamma polypeptide sequence is:

(SEQ ID NO: 1265)
QSIKGNHLVKVYDYQEDGSVLLTCDAEAKNITWFKDGKMIGFLTEDKKKWNLGSNAKDPRG

MYQCKGSQNKSKPLQVYYRMCQNCIELNAATISGFLFAEIVSIFVLAVGVYFIAGQDGVRQ

SRASDKQTLLPNDQLYQPLKDREDDQYSHLQGNQLRRN

The signal peptide of human CD3γ is:

(SEQ ID NO: 700)
MEQGKGLAVLILAIILLQGTLA.

The extracellular domain of human CD3γ is:

(SEQ ID NO: 701)
QSIKGNHLVKVYDYQEDGSVLLTCDAEAKNITWFKDGKMIGFLTEDKKKWNLGSNAKDPRG

MYQCKGSQNKSKPLQVYYRMCQNCIELNAATIS.

The transmembrane domain of human CD3γ is:

(SEQ ID NO: 702)
GFLFAEIVSIFVLAVGVYFIA.

-continued

The intracellular domain of human CD3γ is:

(SEQ ID NO: 703)
GQDGVRQSRASDKQTLLPNDQLYQPLKDREDDQYSHLQGNQLRRN.

The human CD3-delta polypeptide canonical sequence is:

(SEQ ID NO: 704)
MEHSTFLSGLVLATLLSQVSPFKIPIEELEDRVFVNCNTSITWVEGTVGTLLSDITRLDLG

KRILDPRGIYRCNGTDIYKDKESTVQVHYRMCQSCVELDPATVAGIIVTDVIATLLLALGV

FCFAGHETGRLSGAADTQALLRNDQVYQPLRDRDDAQYSHLGGNWARNKS.

The mature human CD3-delta polypeptide sequence is:

(SEQ ID NO: 1266)
FKIPIEELEDRVFVNCNTSITWVEGTVGTLLSDITRLDLGKRILDPRGIYRCNGTDIYKDK

ESTVQVHYRMCQSCVELDPATVAGIIVTDVIATLLLALGVFCFAGHETGRLSGAADTQALL

RNDQVYQPLRDRDDAQYSHLGGNWARNKS.

The signal peptide of human CD3δ is:

(SEQ ID NO: 705)
MEHSTFLSGLVLATLLSQVSP.

The extracellular domain of human CD3δ is:

(SEQ ID NO: 706)
FKIPIEELEDRVFVNCNTSITWVEGTVGTLLSDITRLDLGKRILDPRGIYRCNGTDIYKDK

ESTVQVHYRMCQSCVELDPATVA.

The transmembrane domain of human CD3δ is:

(SEQ ID NO: 707)
GIIVTDVIATLLLALGVFCFA.

The intracellular domain of human CD3δ is:

(SEQ ID NO: 708)
GHETGRLSGAADTQALLRNDQVYQPLRDRDDAQYSHLGGNWARNK.

The human CD3-zeta polypeptide canonical sequence is:

(SEQ ID NO: 709)
MKWKALFTAAILQAQLPITEAQSFGLLDPKLCYLLDGILFIYGVILTALFLRVKFSRSADA

PAYQQGQNQLYNELNLGRREEYDVLDKRRGRDPEMGGKPQRRKNPQEGLYNELQKDKMAEA

YSEIGMKGERRRGKGHDGLYQGLSTATKDTYDALHMQALPPR.

The human TCR alpha chain canonical sequence is:

(SEQ ID NO: 710)
MAGTWLLLLLALGCPALPTGVGGTPFPSLAPPIMLLVDGKQQMVVVCLVLDVAPPGLDSPI

WFSAGNGSALDAFTYGPSPATDGTWTNLAHLSLPSEELASWEPLVCHTGPGAEGHSRSTQP

MHLSGEASTARTCPQEPLRGTPGGALWLGVLRLLLFKLLLFDLLLTCSCLCDPAGPLPSPA

TTTRLRALGSHRLHPATETGGREATSSPRPQPRDRRWGDTPPGRKPGSPVWGEGSYLSSYP

TCPAQAWCSRSALRAPSSSLGAFFAGDLPPPLQAGAA.

The human TCR alpha chain constant region canonical sequence is:

(SEQ ID NO: 711)
PNIQNPDPAVYQLRDSKSSDKSVCLFTDFDSQTNVSQSKDSDVYITDKTVLDMRSMDFKSN

SAVAWSNKSDFACANAFNNSIIPEDTFFPSPESSCDVKLVEKSFETDTNLNFQNLSVIGFR

ILLLKVAGFNLLMTLRLWSS.

The human TCR alpha chain human IgC sequence is:

(SEQ ID NO: 712)
PNIQNPDPAVYQLRDSKSSDKSVCLFTDFDSQTNVSQSKDSDVYITDKTVLDMRSMDFKSN

SAVAWSNKSDFACANAFNNSIIPEDTFFPSPESSCDVKLVEKSFETDTNLNFQNLS

The transmembrane domain of the human TCR alpha chain is:

(SEQ ID NO: 713)
VIGFRILLLKVAGFNLLMTLRLW.

The intracellular domain of the human TCR alpha

-continued chain is:
SS

The human TCR alpha chain V region CTL-L17 canonical sequence is:

(SEQ ID NO: 714)
MAMLLGASVLILWLQPDWVNSQQKNDDQQVKQNSPSLSVQEGRISILNCDYTNSMFDYFLW

YKKYPAEGPTFLISISSIKDKNEDGRFTVFLNKSAKHLSLHIVPSQPGDSAVYFCAAKGAG

TASKLTFGTGTRLQVTL.

The murine TCR alpha chain constant (mTRAC) region canonical sequence is:

(SEQ ID NO: 1267)
XIQNPEPAVYQLKDPRSQDSTLCLFTDFDSQINVPKTMESGTFITDKTVLDMKAMDSKSNG

AIAWSNQTSFTCQDIFKETNATYPSSDVPCDATLTEKSFETDMNLNFQNLSVMGLRILLLK

VAGFNLLMTLRLWSS.

The human TCR beta chain C region (constant domain) canonical sequence is:

(SEQ ID NO: 715)
EDLNKVFPPEVAVFEPSEAEISHTQKATLVCLATGFFPDHVELSWWVNGKEVHSGVSTDPQ

PLKEQPALNDSRYCLSSRLRVSATFWQNPRNHFRCQVQFYGLSENDEWTQDRAKPVTQIVS

AEAWGRADCGFTSVSYQQGVLSATILYEILLGKATLYAVLVSALVLMAMVKRKDF.

The human TCR beta chain human IgC sequence is:

(SEQ ID NO: 716)
EDLNKVFPPEVAVFEPSEAEISHTQKATLVCLATGFFPDHVELSWWVNGKEVHSGVSTDPQ

PLKEQPALNDSRYCLSSRLRVSATFWQNPRNHFRCQVQFYGLSENDEWTQDRAKPVTQIVS

AEAWGRADCGFTSVSYQQGVLSATILYE

The transmembrane domain of the human TCR beta chain is:

(SEQ ID NO: 717)
ILLGKATLYAVLVSALVLMAM.

The human TCR beta chain V region CTL-L17 canonical sequence is:

(SEQ ID NO: 718)
MGTSLLCWMALCLLGADHADTGVSQNPRHNITKRGQNVTFRCDPISEHNRLYWYRQTLGQG

PEFLTYFQNEAQLEKSRLLSDRFSAERPKGSFSTLEIQRTEQGDSAMYLCASSLAGLNQPQ

HFGDGTRLSIL.

The intracellular domain of the human TCR beta chain is:

(SEQ ID NO: 719)
VKRKDF

The human TCR beta chain V region YT35 canonical sequence is:

(SEQ ID NO: 720)
MDSWTFCCVSLCILVAKHTDAGVIQSPRHEVTEMGQEVTLRCKPISGHNSLFWYRQTMMRG

LELLIYFNNNVPIDDSGMPEDRFSAKMPNASFSTLKIQPSEPRDSAVYFCASSFSTCSANY

GYTFGSGTRLTVV.

The murine TCR beta chain constant region canonical sequence is:

(SEQ ID NO: 1268)
EDLRNVTPPKVSLFEPSKAEIANKQKATLVCLARGFFPDHVELSWWVNGKEVHSGVSTDPQ

AYKESNYSYCLSSRLRVSATFWHNPRNHFRCQVQFHGLSEEDKWPEGSPKPVTQNISAEAW

GRADCGITSASYQQGVLSATILYEILLGKATLYAVLVSTLVVMAMVKRKNS

TCRγ9G115

(SEQ ID NO: 1269)
AGHLEQPQISSTKTLSKTARLECVVSGITISATSVYWYRERPGEVIQFLVSISYDGTVRKE

SGIPSGKFEVDRIPETSTSTLTIHNVEKQDIATYYCALWEAQQELGKKIKVFGPGTKLIIT

-continued

DKQLDADVSPKPTIFLPSIAETKLQKAGTYLCLLEKFFPDVIKIHWEEKKSNTILGSQEGN

TMKTNDTYMKFSWLTVPEKSLDKEHRCIVRHENNKNGVDQEIIFPPIKTDVITMDPKDNCS

KDANDTLLLQLTNTSAYYMYLLLLLKSVVYFAIITCCLLRRTAFCCNGEKS

The human TCR gamma chain C region (constant domain) canonical sequence is:

(SEQ ID NO: 721)

DKQLDADVSPKPTIFLPSIAETKLQKAGTYLCLLEKFFPDVIKIHWQEKKSNTILGSQEGN

TMKTNDTYMKFSWLTVPEKSLDKEHRCIVRHENNKNGVDQEIIFPPIKTDVITMDPKDNCS

KDANDTLLLQLTNTSAYYMYLLLLLKSVVYFAIITCCLLRRTAFCCNGEKS.

The human TCR gamma human IgC sequence is:

(SEQ ID NO: 722)

DKQLDADVSPKPTIFLPSIAETKLQKAGTYLCLLEKFFPDVIKIHWQEKKSNTILGSQEGN

TMKTNDTYMKFSWLTVPEKSLDKEHRCIVRHENNKNGVDQEIIFPPIKTDVITMDPKDNCS

KDANDTLLLQLTNTSA

The transmembrane domain of the human TCR gamma chain is:

(SEQ ID NO: 723)

YYMYLLLLLKSVVYFAIITCCLL.

The intracellular domain of the human TCR gamma chain is:

(SEQ ID NO: 724)

RRTAFCCNGEKS

TCRδ2cl5

(SEQ ID NO: 1270)

MQRISSLIHLSLFWAGVMSAIELVPEHQTVPVSIGVPATLRCSMKGEAIGNYYINWYRKTQ

GNTMTFIYREKDIYGPGFKDNFQGDIDIAKNLAVLKILAPSERDEGSYYCACDALKRTDTD

KLIFGKGTRVTVEPRSQPHTKPSVFVMKNGTNVACLVKEFYPKDIRINLVSSKKITEFDPA

IVISPSGKYNAVKLGKYEDSNSVTCSVQHDNKTVHSTDFEVKTDSTDHVKPKETENTKQPS

KSCHKPKAIVHTEKVNMMSLTVLGLRMLFAKTVAVNFLLTAKLFFL

The human TCR delta chain C region canonical sequence is:

(SEQ ID NO: 725)

SQPHTKPSVFVMKNGTNVACLVKEFYPKDIRINLVSSKKITEFDPAIVISPSGKYNAVKLG

KYEDSNSVTCSVQHDNKTVHSTDFEVKTDSTDHVKPKETENTKQPSKSCHKPKAIVHTEKV

NMMSLTVLGLRMLFAKTVAVNFLLTAKLFFL.

The human TCR delta human IgC sequence is:

(SEQ ID NO: 726)

SQPHTKPSVFVMKNGTNVACLVKEFYPKDIRINLVSSKKITEFDPAIVISPSGKYNAVKLG

KYEDSNSVTCSVQHDNKTVHSTDFEVKTDSTDHVKPKETENTKQPSKSCHKPKAIVHTEKV

NMMSLTV

The transmembrane domain of the human TCR delta chain is:

(SEQ ID NO: 727)

LGLRMLFAKTVAVNFLLTAKLFF.

The intracellular domain of the human TCR delta chain is:

L

TFP Expression Vectors

Expression vectors are provided that include: a promoter (eukaryotic elongation factor 1 alpha (EF1α promoter), a signal sequence to enable secretion, a polyadenylation signal and transcription terminator (Bovine Growth Hormone (BGH) gene), an element allowing episomal replication and replication in prokaryotes (e.g., SV40 origin and ColE1 or others known in the art) and elements to allow selection (ampicillin resistance gene and zeocin marker).

The TFP-encoding nucleic acid construct was cloned into the pLRPO lentiviral expression vector as is described above. The anti-CD70.TFP lentiviral transfer vectors were used to produce the genomic material packaged into the VSV-G pseudotyped lentiviral particles. Expi293F-cells were suspended in free-style (FS) media and allowed to incubate at 37 degrees C., 8% $CO_2$, 150 rpm for 1-3 hours. The transfer DNA plasmid, Gag/Pol plasmid, Rev plasmid, and VSV-G plasmid were diluted in FS media. PEIpro was then diluted in FS media and added to the mixture of DNA and media. The incubated cells were added to this mixture and are incubated at 37 degrees C., 8% $CO_2$, 150 rpm for 18-24 hours. The following day, the supernatant was replaced with fresh media and supplemented with sodium butyrate and incubated at 37° C. for an additional 24 hours. The lentivirus containing supernatant was then collected into a 50 mL sterile, capped conical centrifuge tube and put on ice. After centrifugation at 3000 rpm for 30 minutes at 4° C., the cleared supernatant was filtered with a low-protein binding 0.45 μm sterile filter. The virus was subsequently concentrated by Lenti-X. The virus stock preparation was either used for infection immediately or aliquoted and stored at −80° C. for future use.

Example 4: Generation of T Cell Receptor Fusion Protein T Cells

T-Cell Activation, Transduction, and Expansion

T cells were purified from healthy donor leukopak via positive selection of CD4+ and CD8+ T cells with CD4 and CD8 microbeads from Miltenyi Biotech. On day 0, T cells, freshly isolated or thawed from previously prepared frozen vials, were activated by MACS GMP T cell TransAct (Miltenyi Biotech), in the presence of human IL-7 and IL-15 (both from Miltenyi Biotech, premium grade). On day 1, activated T cells were transduced with lentivirus encoding the CD70.TFP. On day 4, the cells were washed, subcultured in fresh medium with cytokines and then expanded up to day 10 by supplementing fresh medium on day 7 and day 9. At each day of subculture, cells were harvested, washed, and resuspended with fresh cytokine-containing medium to maintain the cell suspension at $0.5\times10^6$ cells/mL.

Verification of TFP Expression by Cell Staining

Following lentiviral transduction, expression of CD70.TFPs by transduced T cells was confirmed by flow cytometry, using a CD70-Fc tag or anti-VHH antibody, on day 10 of cell expansion. T cells were washed three times in PBS and then re-suspended in PBS at $2\times10^5$ cells per well. For dead cell exclusion, cells were incubated with LIVE/DEAD® Fixable Blue Dead Cell Stain (Invitrogen) for 30 minutes at 4° C. in the dark. Cells were then washed twice with PBS and blocked with human FcR Blocking Reagent (Miltenyi Biosciences) for 20 minutes. Cells were then incubated with CD70-Fc tag or anti-VHH antibody for 30 minutes at 4° C. in the dark. Cells were then washed twice with staining buffer (PBS with 2% FBS) and stained with FITC-conjugated anti-human Fc or FITC-conjugated streptavidin for detection of the CD70-Fc tag or the anti-VHH, respectively, for 20 mins at 4° C. in the dark. Cells were then washed twice and resuspended with staining buffer (PBS with 2% FBS) and submitted to data acquisition on LSR Fortessa™-X20 (BD Biosciences) using FACS Diva software. The TFP expression was analyzed, with FlowJo® (BD Biosciences), from live T cells (CD3+ alive cells). As is shown in FIG. 6, binding of the CD70-Fc tag was detected in all of the CD70.TFP transduced T cells. Representative data is shown for T cells from one donor. Binding was not detected by untransduced cells. Binding of the anti-VHH antibody was detected in T cells transduced CD70.TFPs having the binders R3P2G8 VHH, R3P3H12 VHH, R3P15F6 VHH, R3aP9D10 VHH, R2P16D9 VHH, and R3P5A1 VHH. Binding was not detected in untransduced T cells or in T cells transduced with TFPs having the binders 1F6 scFv, R3aP3E8 VHH, R2P14A12 VHH, R3aP4D6 VHH, or the anti-CD19 scFv binder.

Example 5: Phenotypin2 of CD70.TFP T Cells

Figures 1, 8A:
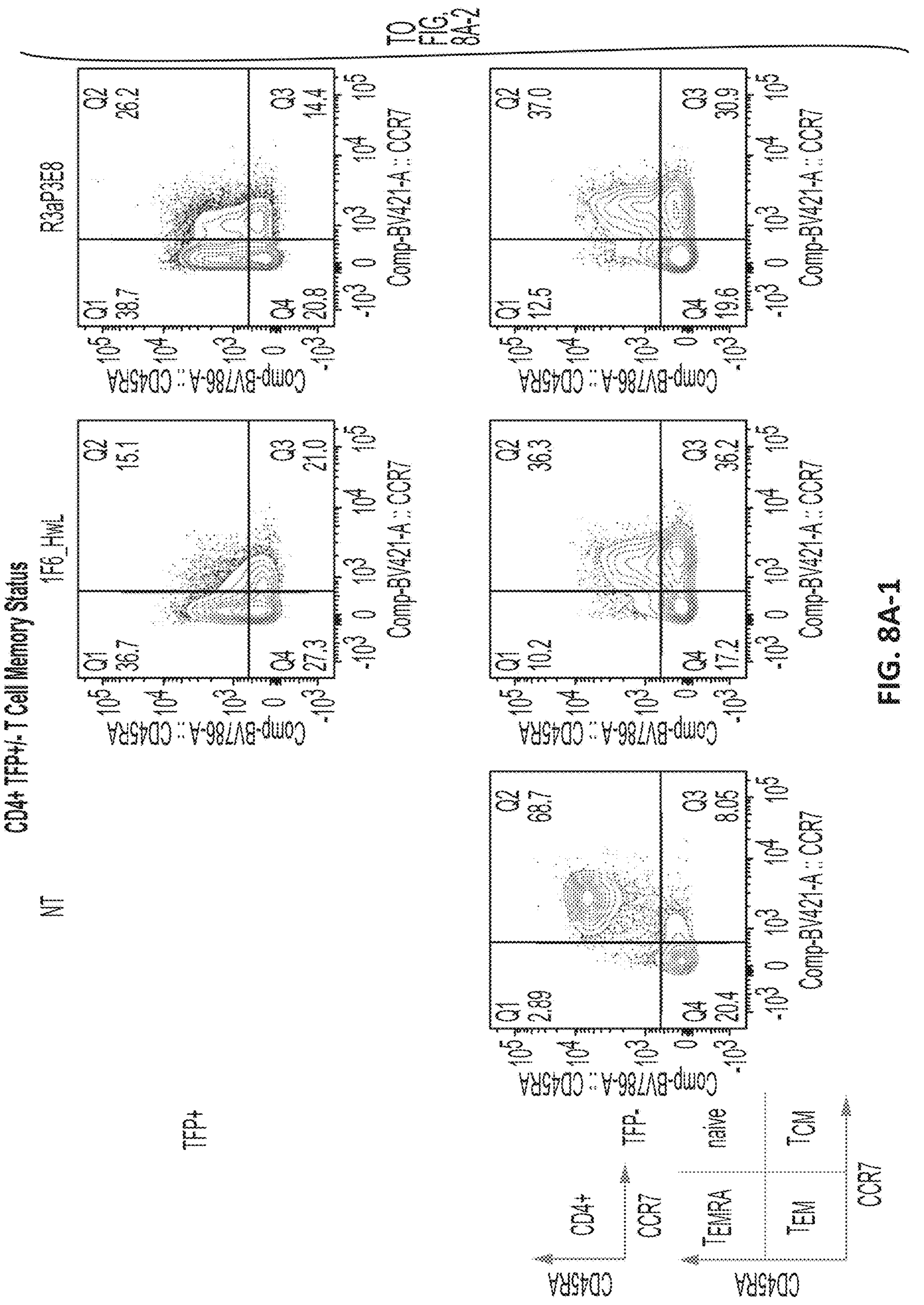
FIGS. 8A-8F is a graphical representation of flow cytometry data detecting T cell memory status by staining for cell surface expression of CD45RA and CCR7 in T cells transduced with TFPs having the binders shown or untransduced control T cells.
Figures 2, 8A:
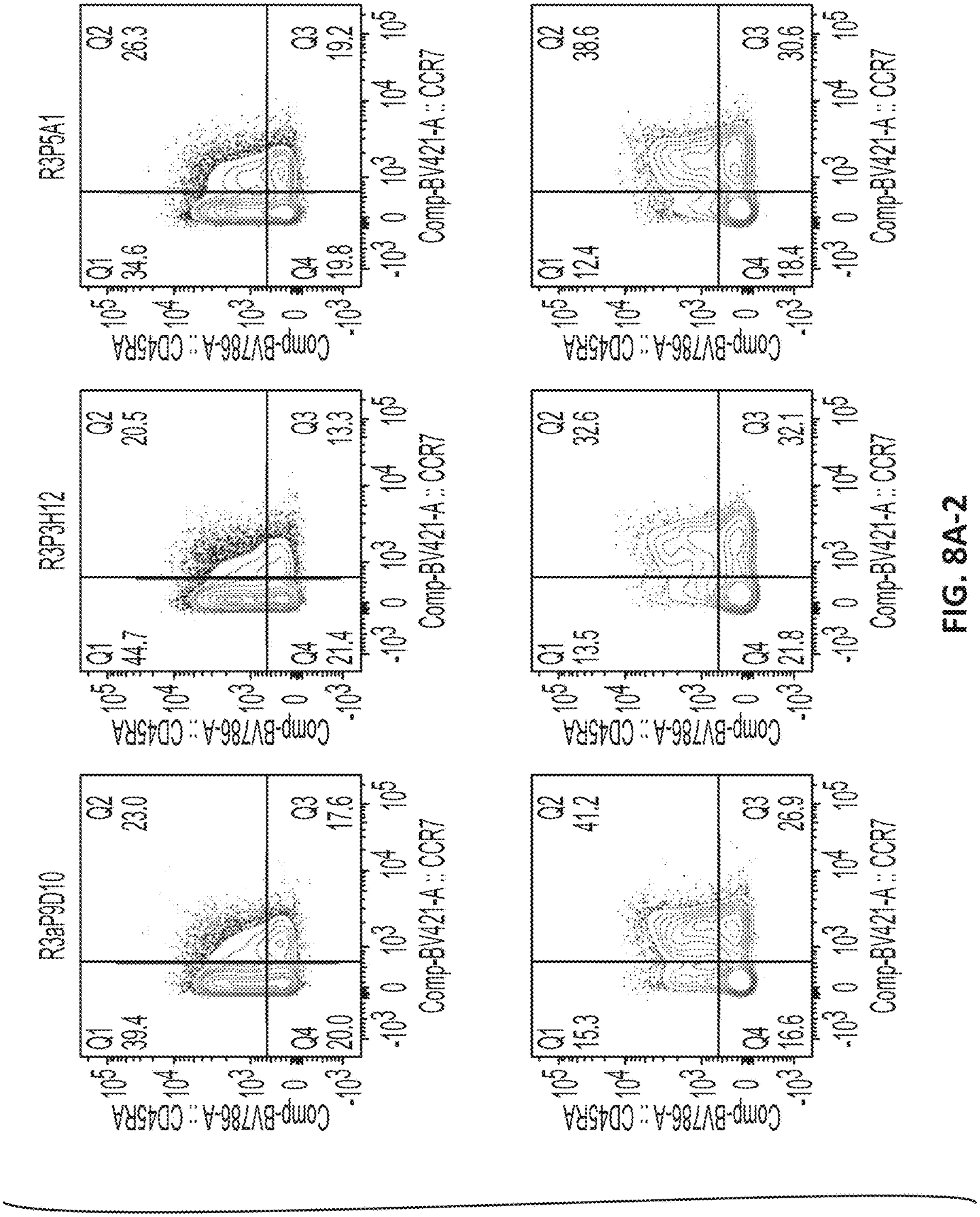
Figure 8B:
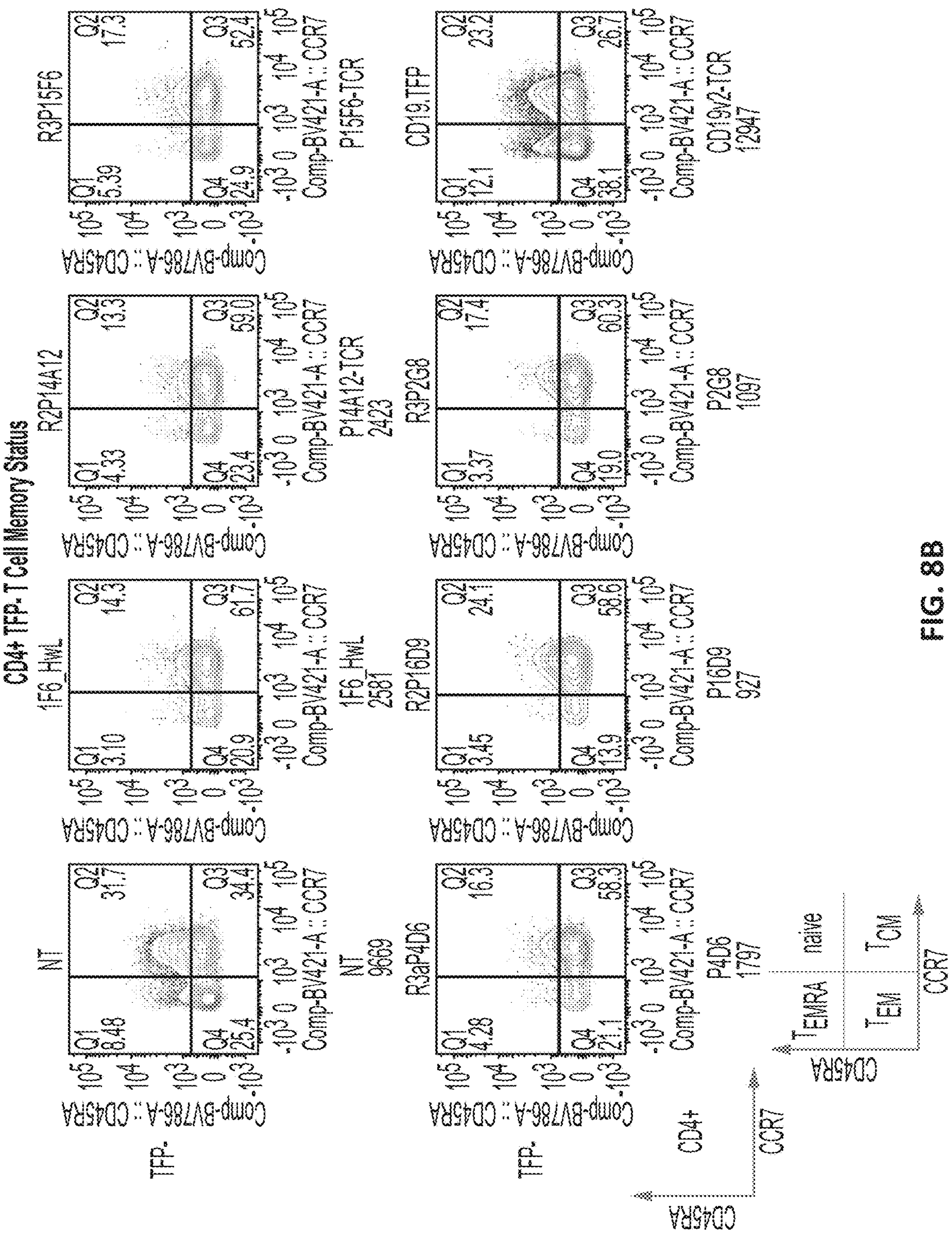
Figure 8C:
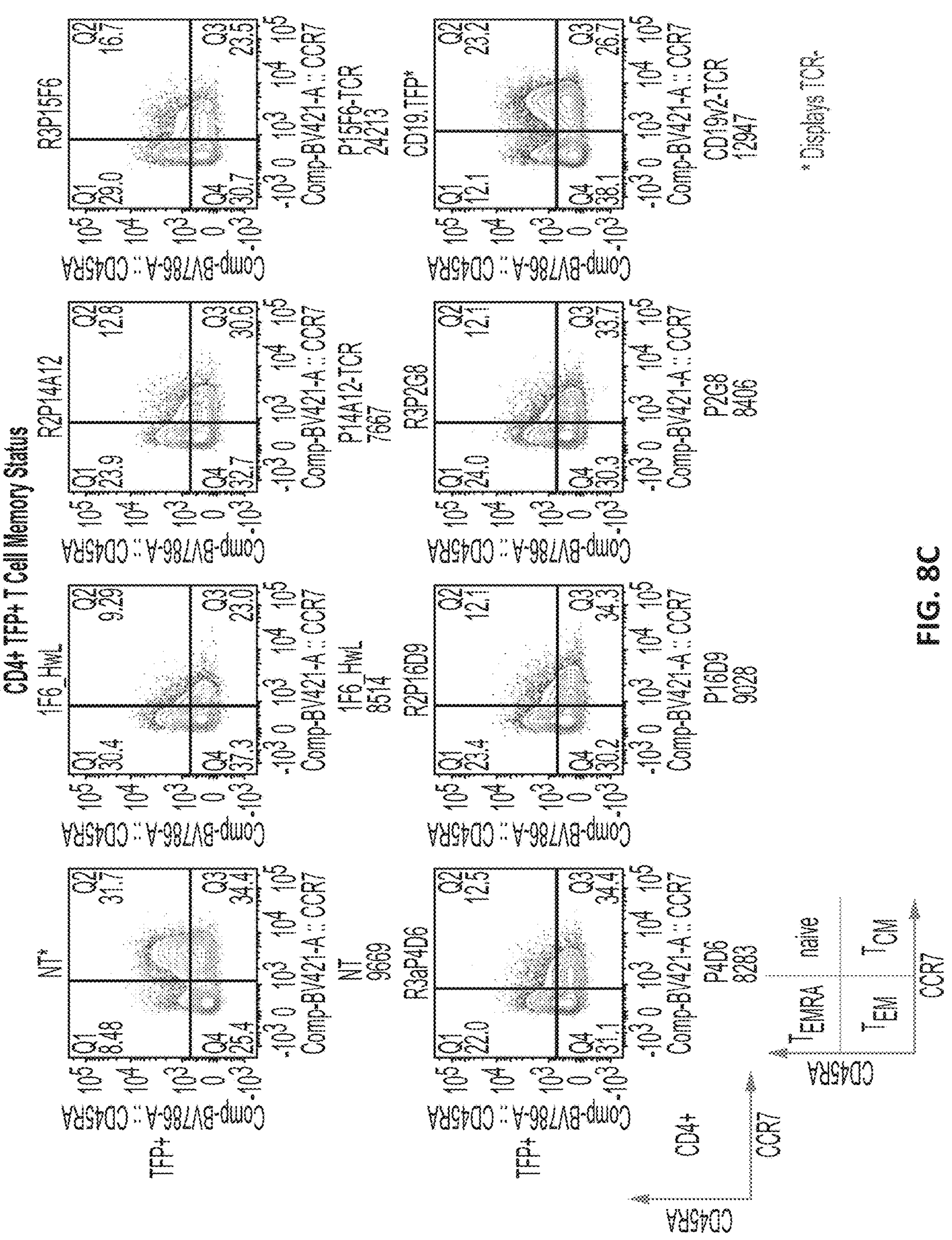
Figure 8D:
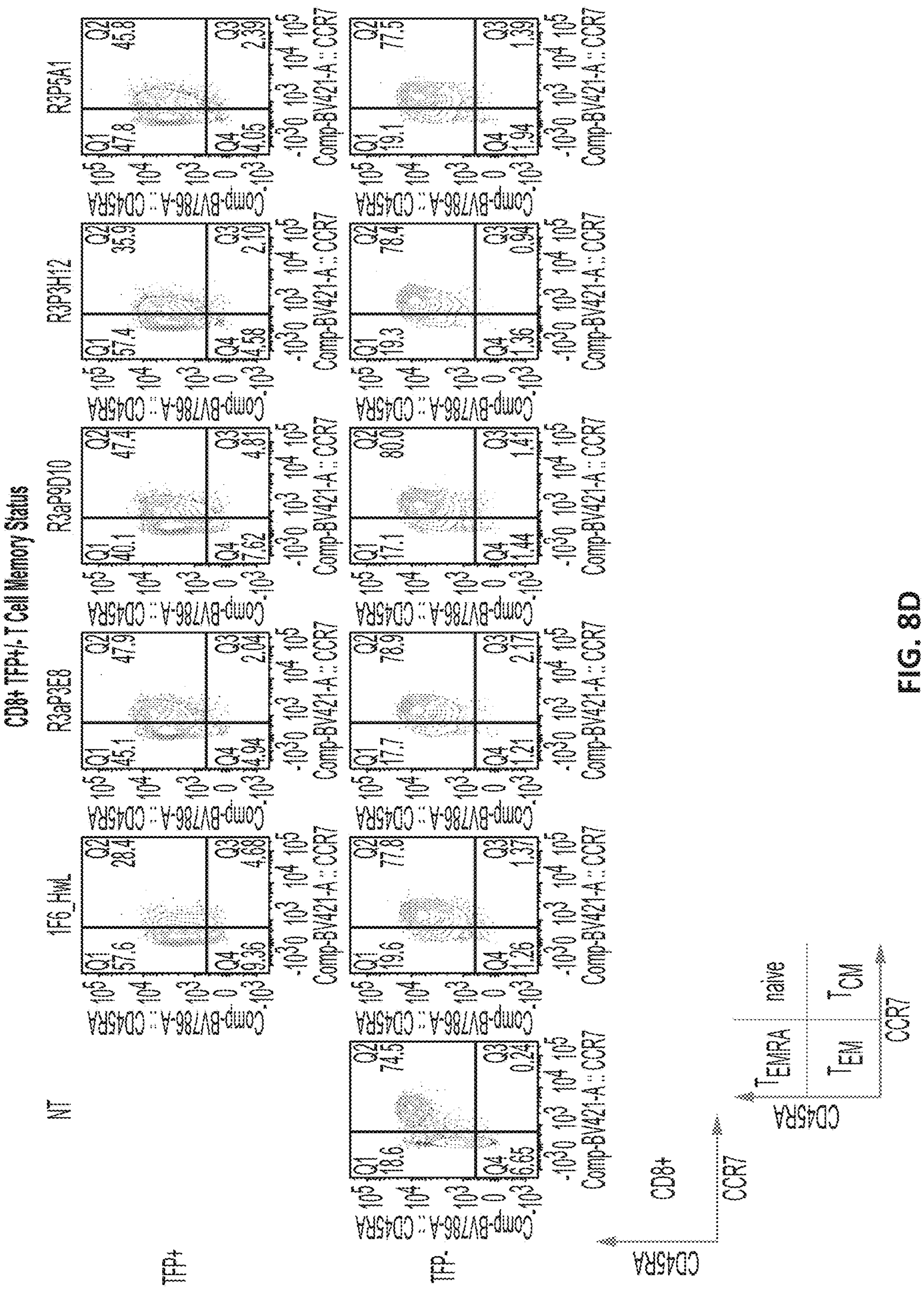
Figure 8E:
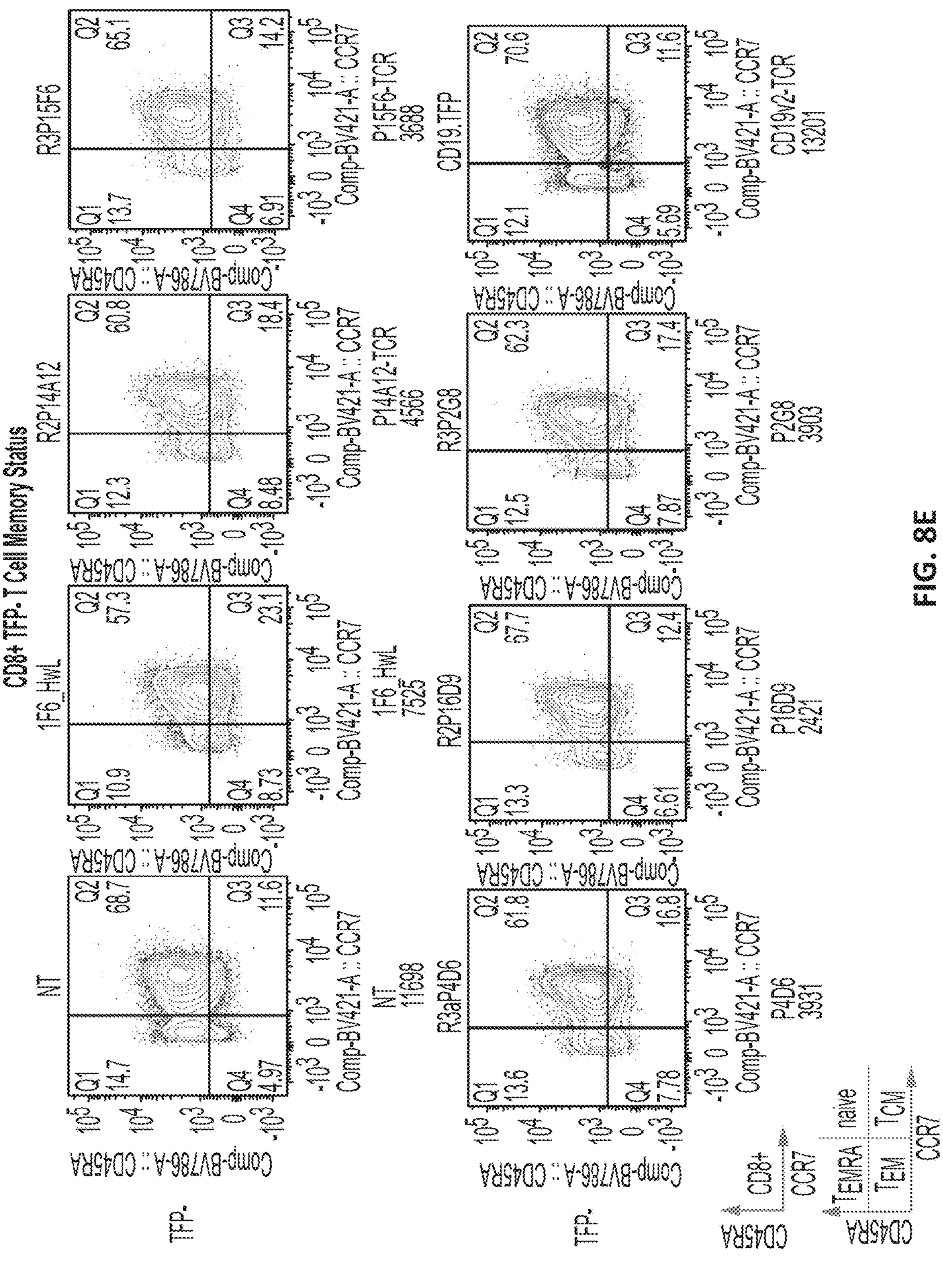
Figure 8F:
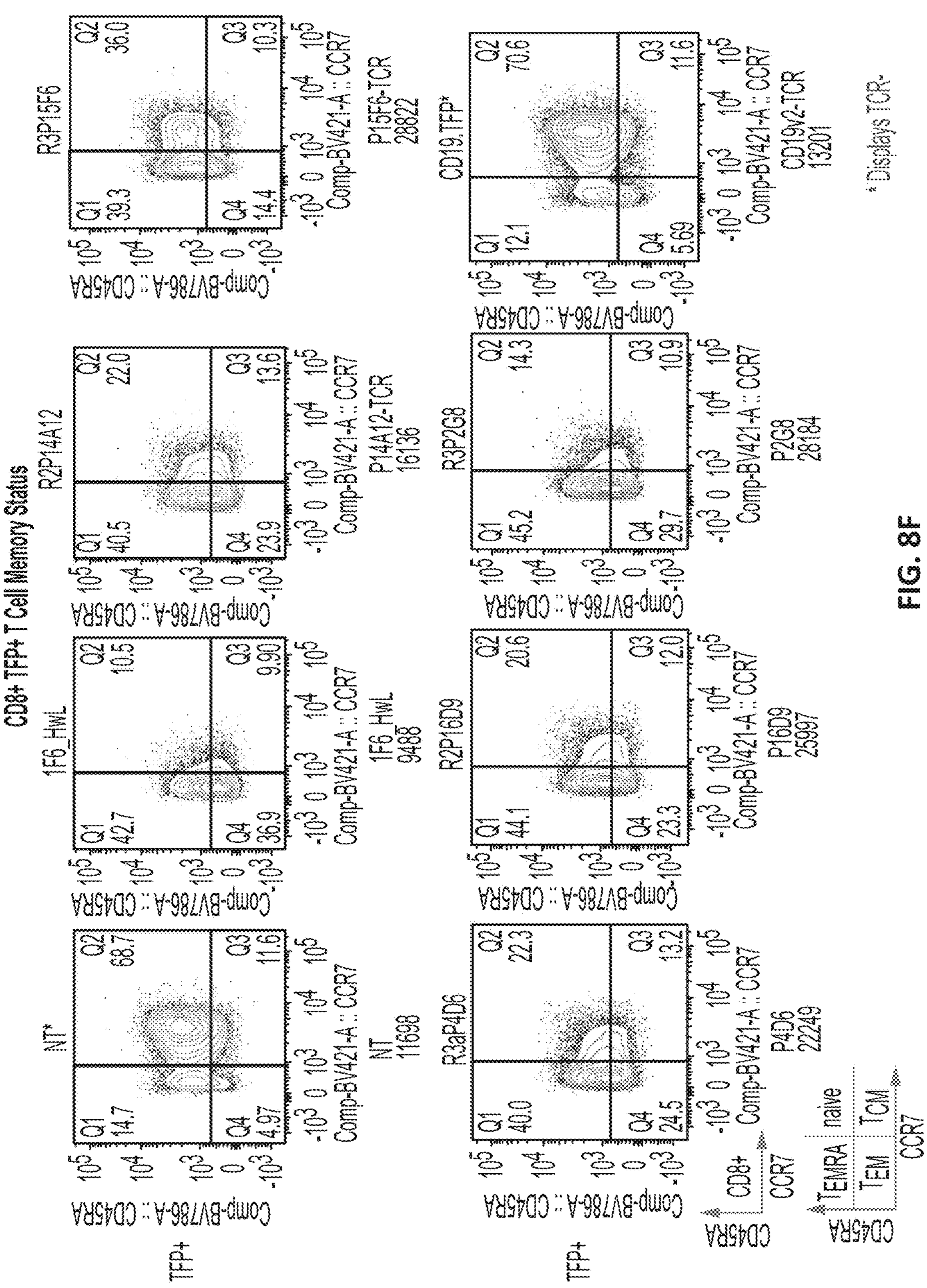
Figure 9A:
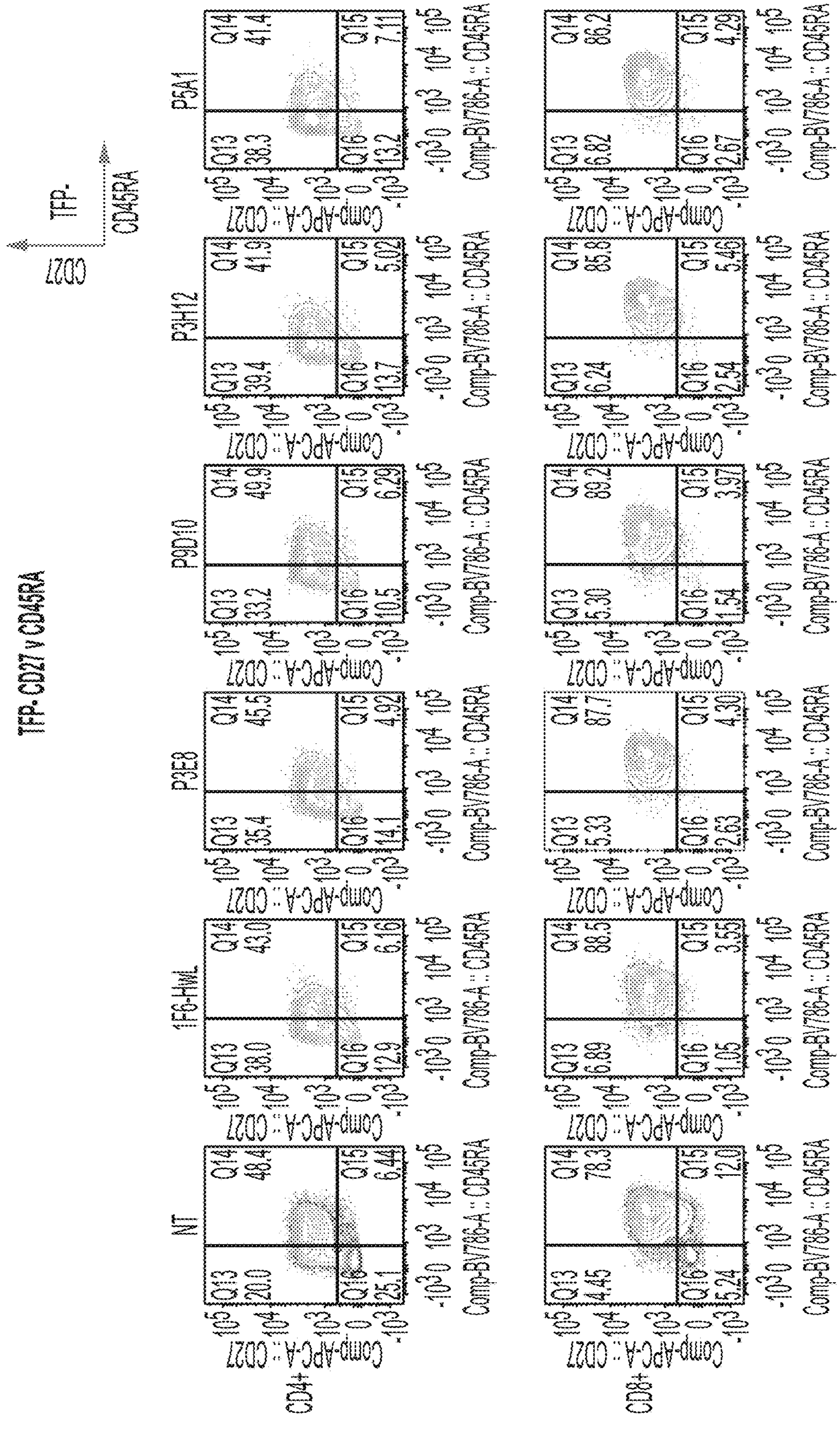
FIGS. 9A-9D is a graphical representation of flow cytometry data detecting cell surface expression of CD45RA and CD27 in T cells transduced with TFPs having the binders shown or untransduced control T cells.
Figures 1, 9B:
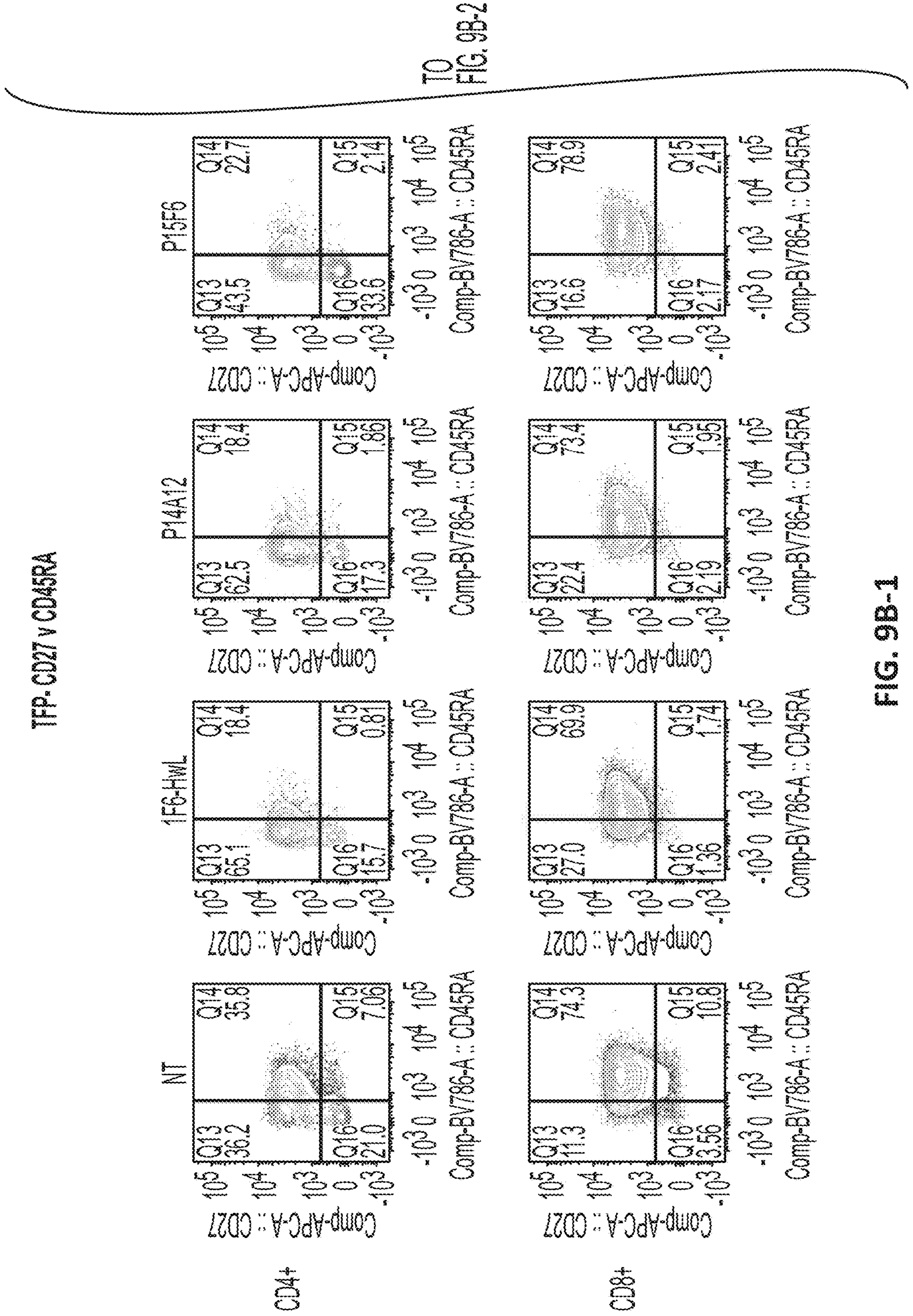
Figures 2, 9B:
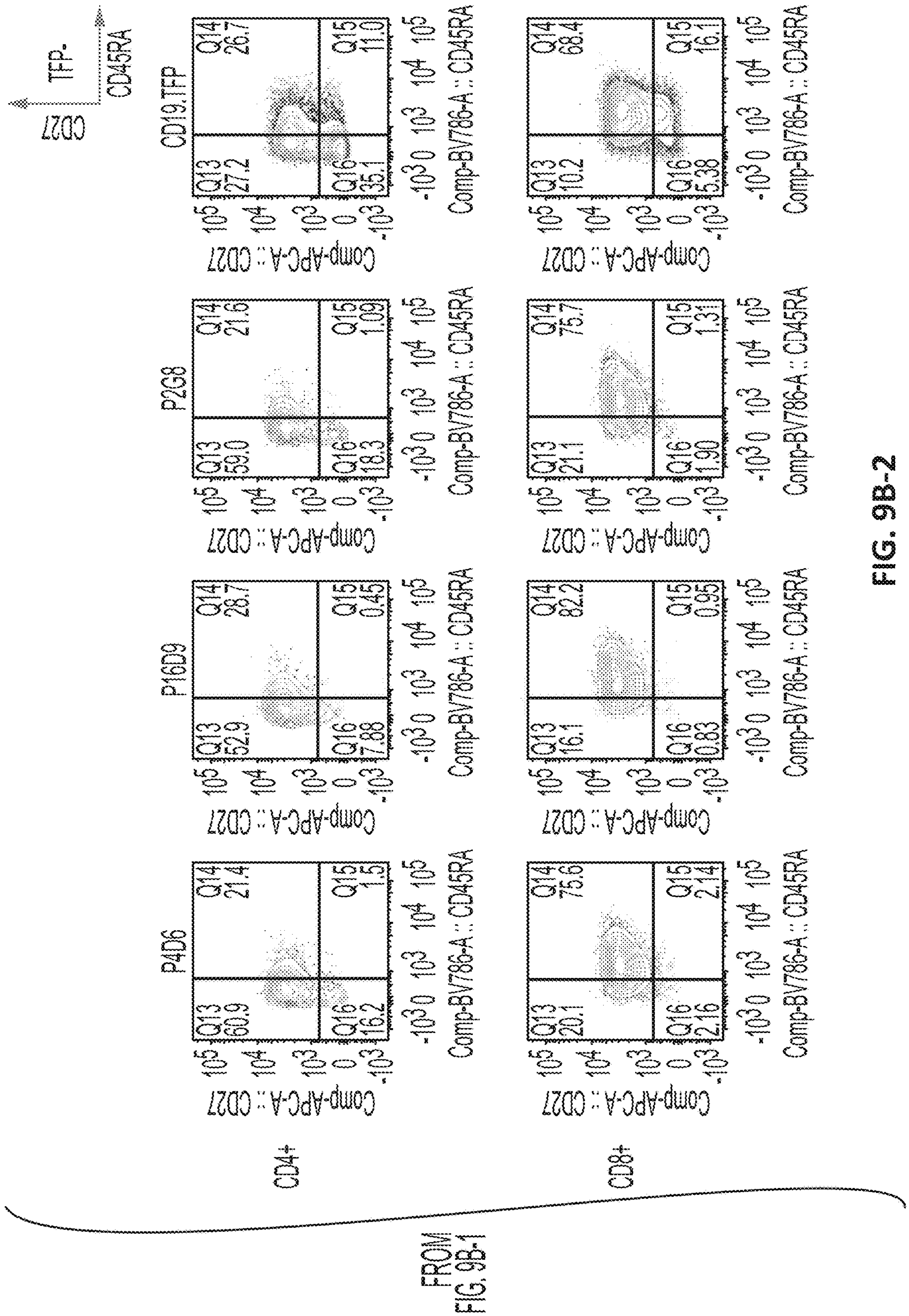
Figures 1, 9C:
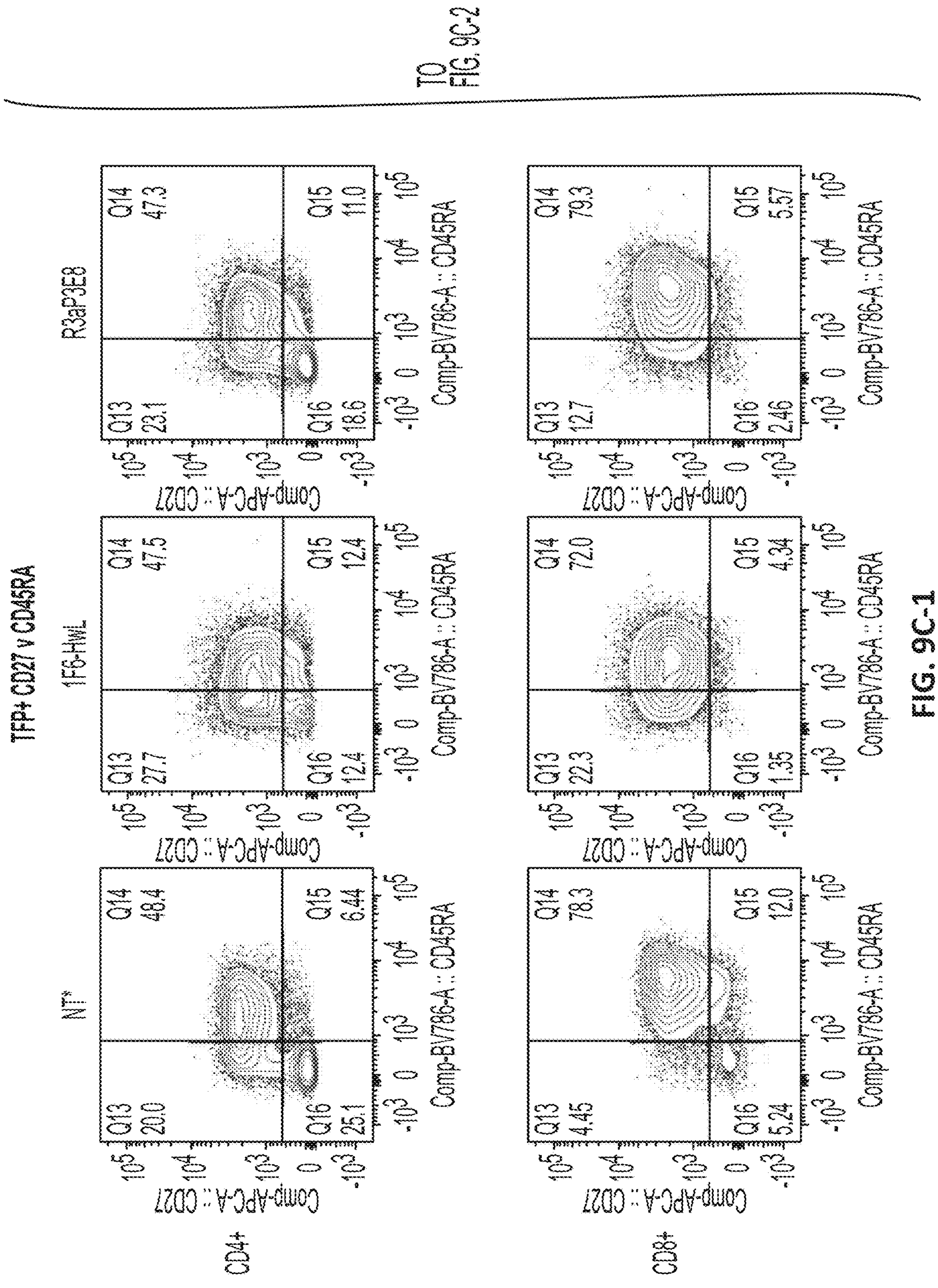
Figures 2, 9C:
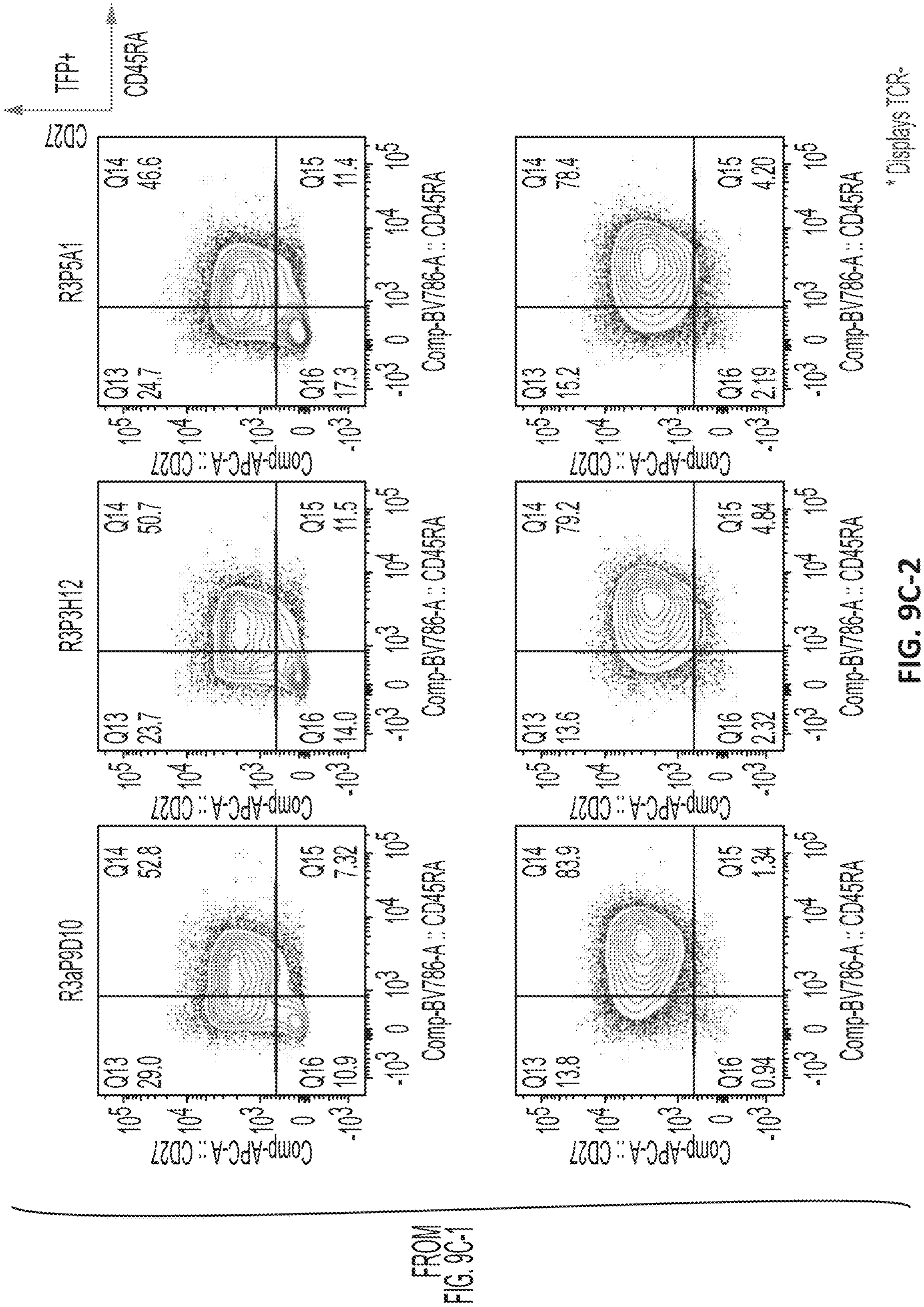
Figures 1, 9D:
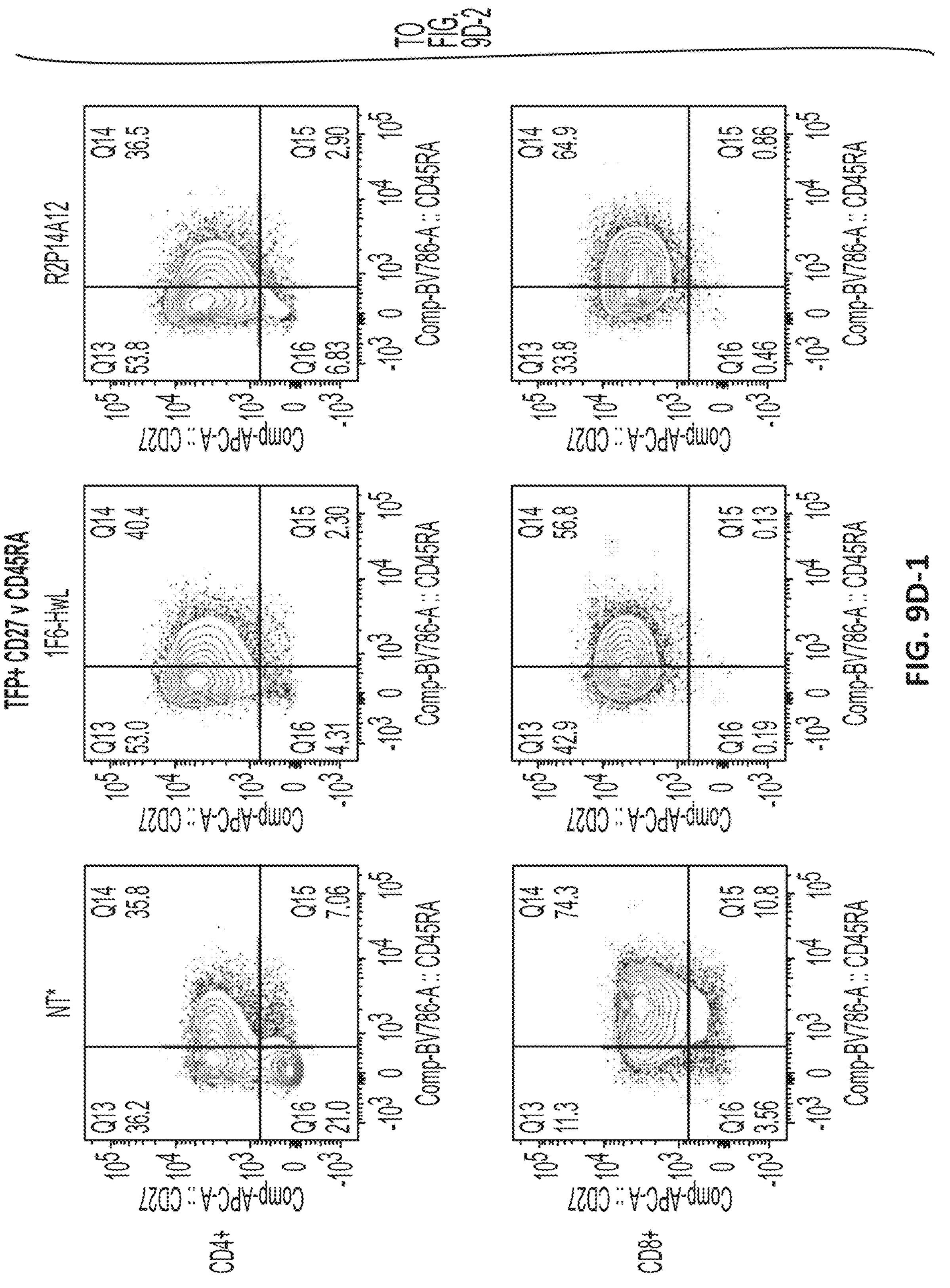
Figures 2, 9D:
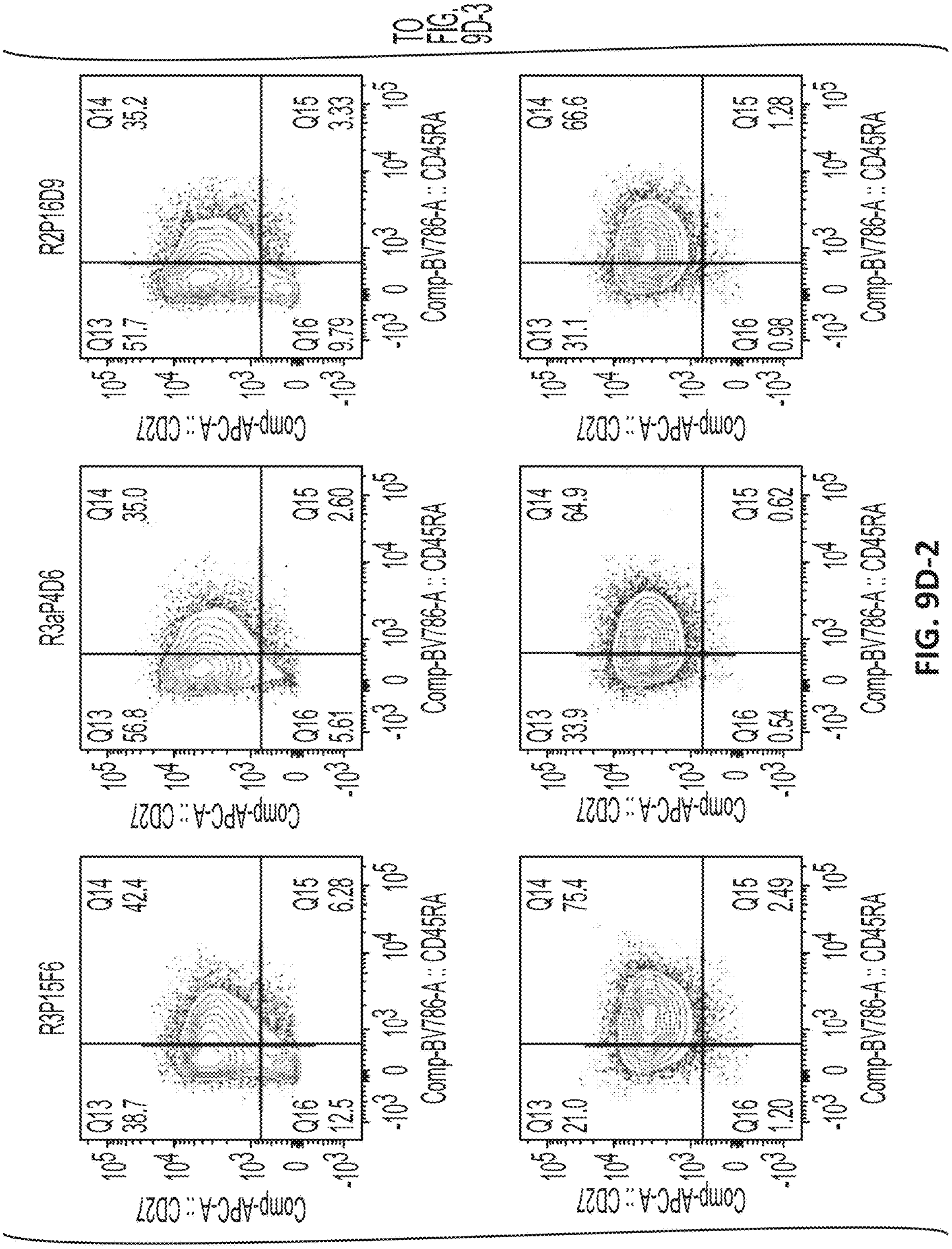
Figures 3, 9D:
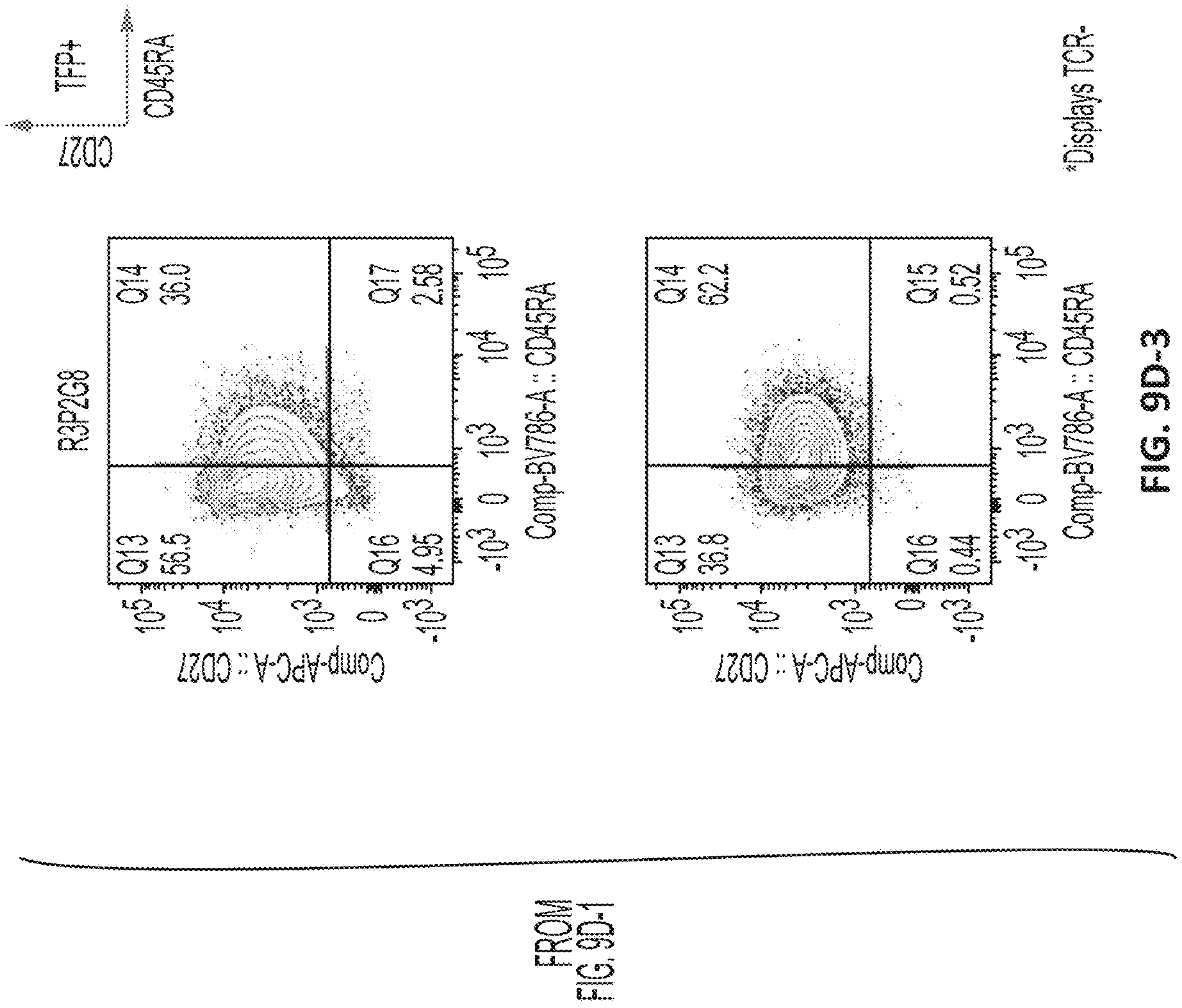

Phenotyping of the CD70.TFP transduced T cells was measured. CD70.TFP T cells or non-transduced T cells were generated as described above. At day 10 of expansion, T cells from three donors were harvested and the cells were characterized by flow cytometry. The proportion of CD4+ to CD8+ T cells was determined by flow cytometry with APC-Cy7 (to detect CD4+) and PerCP-Cy 5.5 (to detect CD8+) in TFP− and TFP+ T cells. The memory status of the T cells was determined by flow cytometry with BV786 (to detect CD45RA) and BV421 (to detect CCR7) in TFP− and TFP+CD4+ T cells (FIGS. 8A-8C) and in TFP− and TFP+ CD8+ T cells (FIGS. 8D-8F). FIGS. 9A-9D show CD27 staining against CD45RA in CD4+ and CD8+ T cells. As is shown in FIGS. 8 and 9, TFP+ cells display a higher level of activation than TFP− negative cells, while still retaining a population of naïve-like cells that is especially evident in the CD8+ fraction of TFP+ cells. T cells from 1 Representative Donor are Shown for Each FACS Plot.

Example 6: Proliferation of CD70.TFP T Cells

Figure 10:
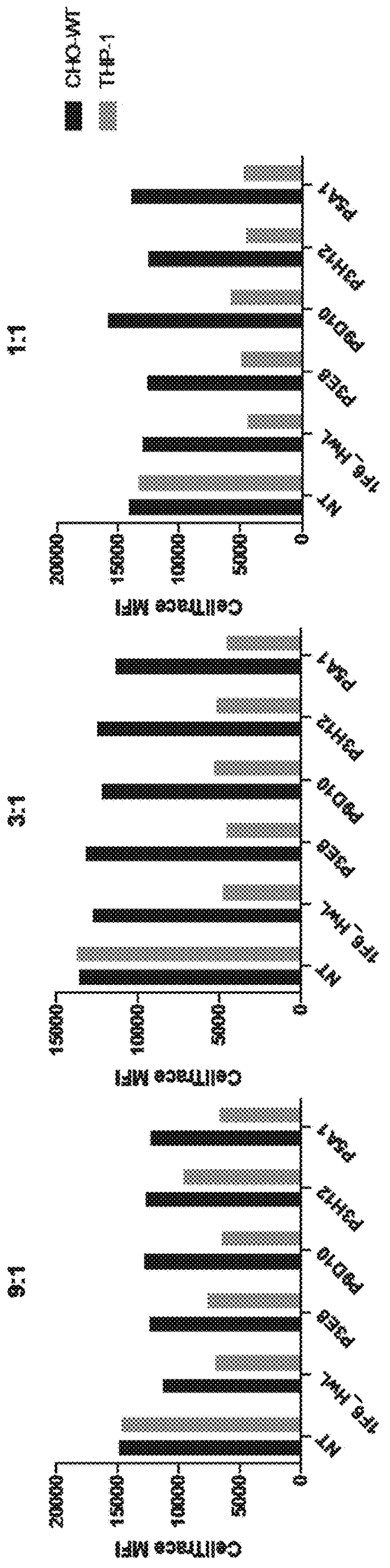
FIG. 10 is a series of graphs showing proliferation of T cells transduced with TFPs having the binders shown or untransduced control T cells from three donors when co-cultured for 24 hours with CHO-WT cells or THP-1 cells at an effector:target cell ratio of 9:1, 3:1 and 1:1.

Proliferation of CD70.TFP T cells was assessed. CD70.TFP T cells with the binding domain indicated were mixed with target tumor cells at the effector:target cell ratio specified and proliferation was measured. Target cell lines used were CHO-WT cells with negative CD70 expression and THP-1 with high CD70 expression. Day 10 TFP T cells were thawed and rested in TexMACS media+3% human AB serum+1% Penicillin/Streptomycin+12.5 ng/mL IL-7+12.5 ng/mL IL-15 for 24 hours at 37° C. After this resting period, the T cells were washed twice with PBS and incubated with 1 uL CellTrace Violet dye (reconstituted per manufacturer's directions) per 1e6 T cells/mL in pre-warmed PBS for 20 minutes in a 37° C. waterbath, protected from light. The reaction was stopped with a serum-containing media, such as RPMI-1640+10% FBS (R10), incubated for 5 mins, and washed twice. Meanwhile, target tumor cells were resuspended in PBS at a concentration of 5e6 cells/mL and were incubated at a 1:1 ratio with Streck Cell Preservative for 25 minutes. Target tumor cells were then washed twice before resuspending in R10 at a concentration of 1e5 cells/mL and aliquoting 100 uL per well into a 96-well plate. CellTrace-stained CD70.TFP T cells were then resuspended in R10 at a concentration of 1e6 cells/mL and added to the same 96-well plate at 9:1, 3:1, and 1:1 effector:target ratios. Well volumes are all adjusted to 200 uL with R10 before incubation for 72 hours. After 72 hours, plates are processed for flow cytometric analysis and MFI (mean fluorescence intensity) was measured. A decrease in MFI is indicative of cell division/proliferation. As is shown in FIG. 10, T cells expressing the CD70.TFPs shown demonstrated enhanced proliferation when contacted with the CD70 expressing THP-1 cells relative to CHO-WT cells.

Example 7: Luciferase-Based Cytotoxicity Assay

The luciferase-based cytotoxicity assay assesses the cytotoxicity of TFP T cells by indirectly measuring the luciferase enzymatic activity in the residual live target cells after co-culture. CD70− positive THP-1 and CD70-negative K562 cells were modified to overexpress firefly luciferase via transduction with firefly luciferase encoding lentivirus followed with antibiotic selection to generate stable cell line.

The target cells were plated at 10000 cells per well in 96-well plate. The CD70.TFP transduced or non-transduced T cells were added to the target cells at different effector-to-target ratios (9:1, 3:1 or 1:1). The mixture of cells was then cultured for 24 at 37° C. with 5% $CO_2$ before the luciferase enzymatic activity in the live target cells was measured by the Bright-Glo® Luciferase Assay System (Promega®, Catalogue number E2610). The cells were spun into a pellet and resuspended in medium containing the luciferase substrate. The percentage of tumor cell killing was then calculated with the following formula: % Cytotoxicity=100%×[1−RLU (Tumor cells+T cells)/RLU (Tumor cells)].

Figure 11:
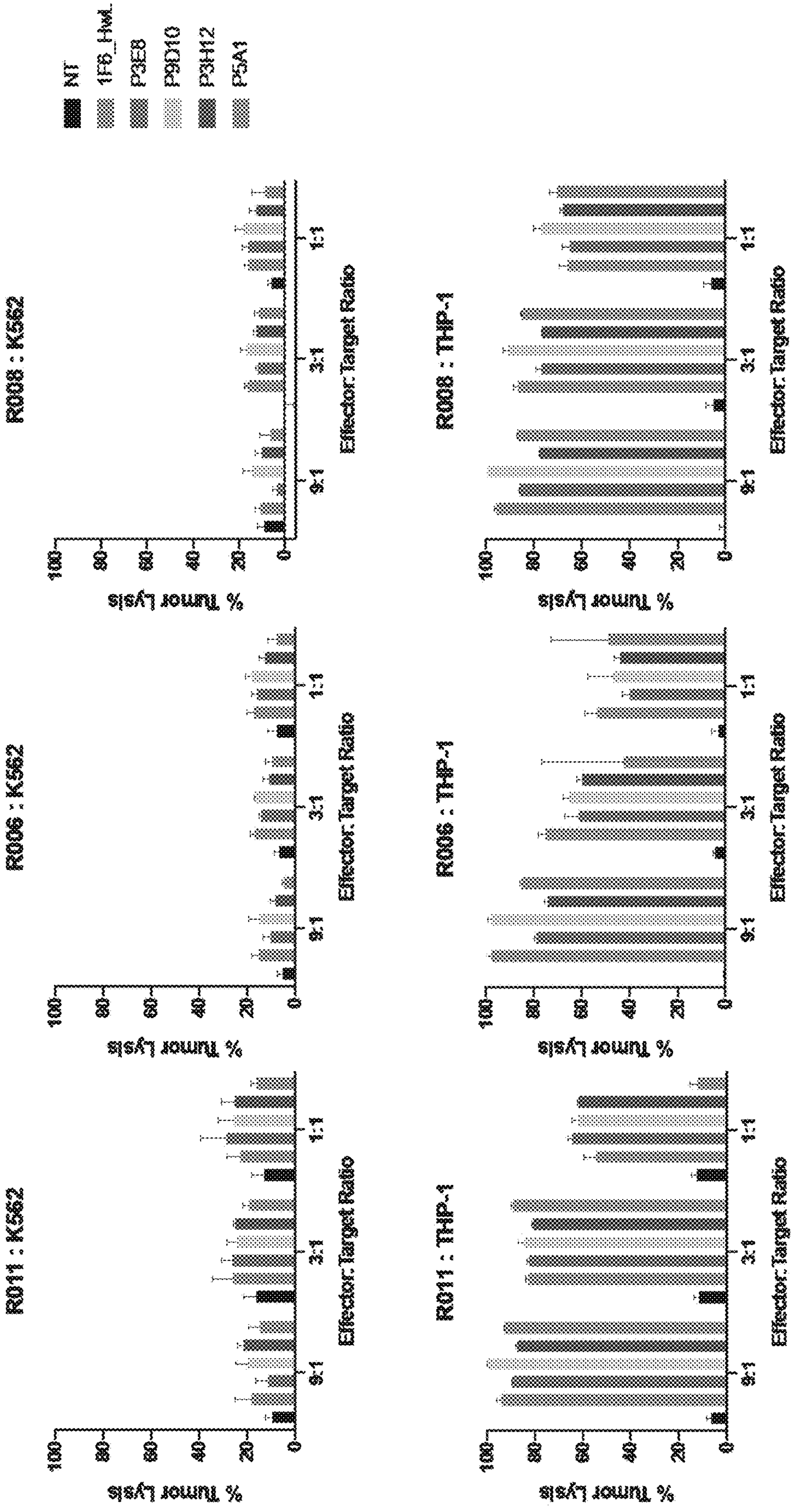
FIG. 11 is a series of graphs showing cytotoxicity of T cells transduced with TFPs having the binders shown or untransduced control T cells from three donors when co-cultured for 24 hours with CHO-WT cells or THP-1 cells at an effector:target cell ratio of 9:1, 3:1 and 1:1.

As is shown in FIG. 11, for all three donors, at both ratios of effector to target cell ratios, CD70.TFP transduced T cells having each of the 1F6 scFv, R3aP3E8 VHH, R3aP9D10 VHH, R3P3H12 VHH, and R3P5A1 VHH antigen binding domains from three donors demonstrated enhanced cytotoxicity towards CD70-positive THP-1 cells relative to CD70.TFP-transduced T cells co-cultured with CD70-negative K562 target cells or non-transduced control T cells co-cultured with either THP-1 or K562 cells. For each effector:target ratio, shown from right to left, is the target cells shown with untransduced T cells, or CD70.TFP T cells having the 1F6 scFv, R3aP3E8 VHH, R3aP9D10 VHH, R3P3H12 VHH, and R3P5A1 VHH antigen binding domains.

Example 8: Cytokine Secretion Measurement by MSD

A measure of effector T-cell activation and proliferation associated with the recognition of cells bearing cognate antigen is the production of effector cytokines such as interferon-gamma (IFN-γ), interleukin 2 (IL-2) and tumor necrosis factor alpha (TNF-α).

Target-specific cytokine production including IFN-γ, IL-2, TNF-αm and GM-CSF by TFP T cells was measured from supernatants harvested 24 hours after the co-culture of T cells with CD70– positive THP-1 cells and CD70-negative K562 target cells using the U-PLEX® Biomarker Group I (hu) Assays (Meso Scale Diagnostics®, LLC, catalog number: K15067L-4).

Figure 12A:
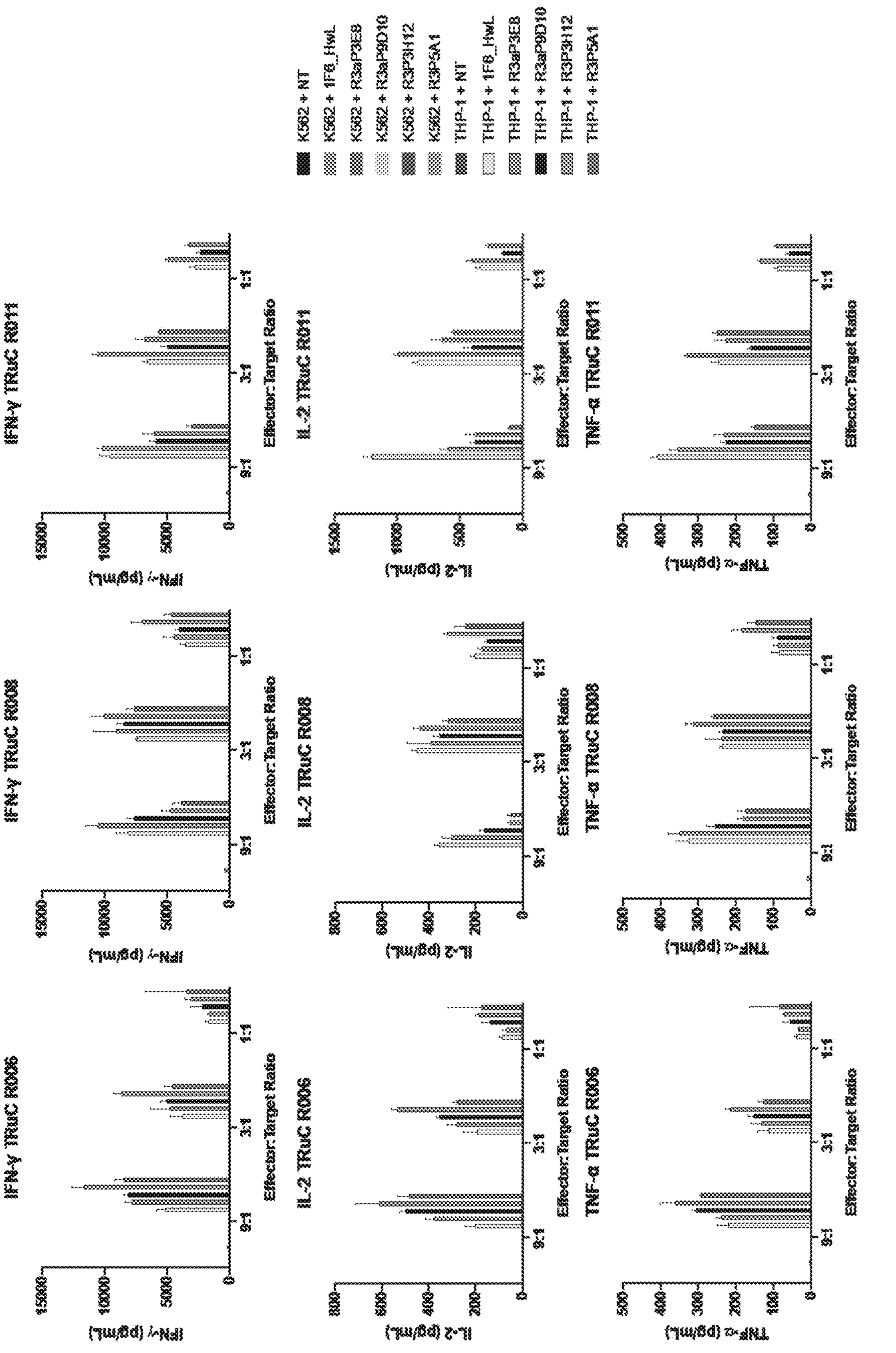
FIGS. 12A and 12B are a series of graphs showing cytokine secretion by T cells transduced with TFPs having the binders shown or untransduced control T cells from three donors when co-cultured for 24 hours with CHO-WT cells or THP-1 cells at an effector:target cell ratio of 9:1, 3:1 and 1:1.
Figure 12B:
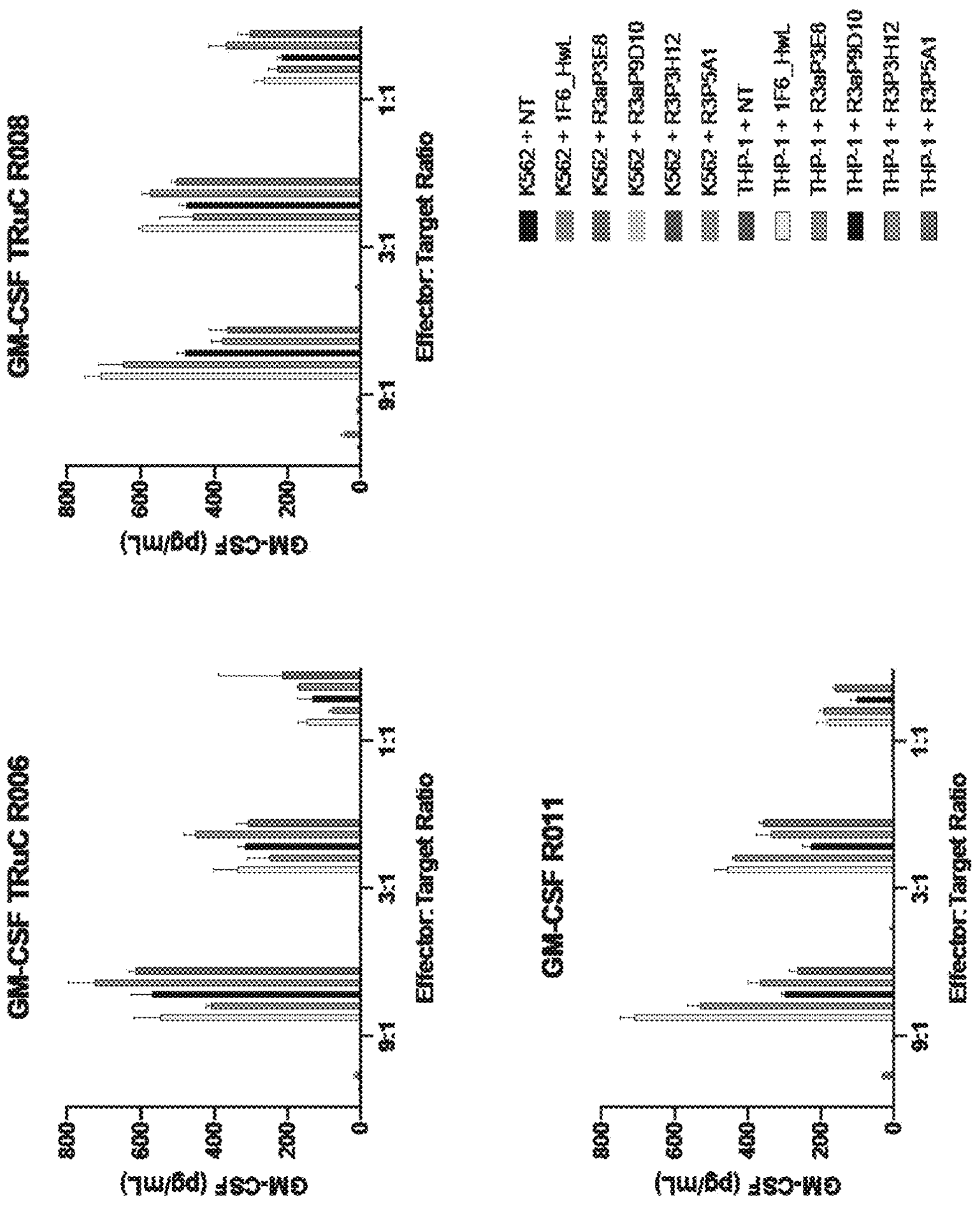

As is shown in FIGS. 12A and 12B, increased levels of IFN-γ, IL-2, TNF-α, and GM-CSF were observed in CD70.TFP-transduced T cells having each of the 1F6 scFv, R3aP3E8 VHH, R3aP9D10 VHH, R3P3H12 VHH, and R3P5A1 VHH antigen binding domains from three donors co-cultured with CD70-positive THP-1 target cells relative to CD70.TFP-transduced T cells co-cultured with CD70-negative K562 target cells or non-transduced control T cells co-cultured with either THP-1 or K562 cells. For each effector:target ratio, for IFN-γ, IL-2, and TNF-α, shown from left to right, is K562 target cells with untransduced T cells, or with CD70.TFP T cells having the 1F6 scFv, R3aP3E8 VHH, R3aP9D10 VHH, R3P3H12 VHH, and R3P5A1 VHH antigen binding domains and THP-1 target cells with CD70.TFP T cells having the 1F6 scFv, R3aP3E8 VHH, R3aP9D10 VHH, R3P3H12 VHH, and R3P5A1 VHH antigen binding domains. For each effector:target ratio, for GM-CSF, shown from left to right, is K562 target cells with untransduced T cells, or with CD70.TFP T cells having the 1F6 scFv, R3aP3E8 VHH, R3aP9D10 VHH, R3P3H12 VHH, and R3P5A1 VHH antigen binding domains and THP-1 target cells with untransduced T cells, or with CD70.TFP T cells having the 1F6 scFv, R3aP3E8 VHH, R3aP9D10 VHH, R3P3H12 VHH, and R3P5A1 VHH antigen binding domains.

Example 9: T Cell Receptor Fusion Protein T Cells Generated with and without CD70 Antibody T-cell activation, transduction, and expansion. T cells were purified from healthy donor leukopak via positive selection of CD4+ and CD8+ T cells with CD4 and CD8 microbeads from Miltenyi Biotech. On day 0, T cells, freshly isolated or thawed from previously prepared frozen vials, were activated by MACS GMP T cell TransAct (Miltenyi Biotech), in the presence of human IL-7 and IL-15 (both from Miltenyi Biotech, premium grade). Cells were cultured in the absence of anti-CD70 antibody, or in 5 μM 41D12 anti-CD70. On day 1, activated T cells were transduced at $1\times10^6$ cells/mL with lentivirus encoding the CD70.TFP (having the R3aP3E8 VHH binding domain, also labeled as 70-001 in some instances), or CD70.TFP with PD-1(PD-1) CD28 switch. On day 4, the cells were washed, subcultured in fresh medium with cytokines and then expanded up to day 10. 41D12 antibody was added at 5.0 μM if added initially. The cells were subcultured at 7 and 9. At each day of subculture, cells were harvested, washed, and resuspended with fresh cytokine-containing medium to maintain the cell suspension at $0.5\times10^6$ cells/mL 41D12 was added at 1.0 μM on day 7 to 41D12 treated cells.

Figure 13:
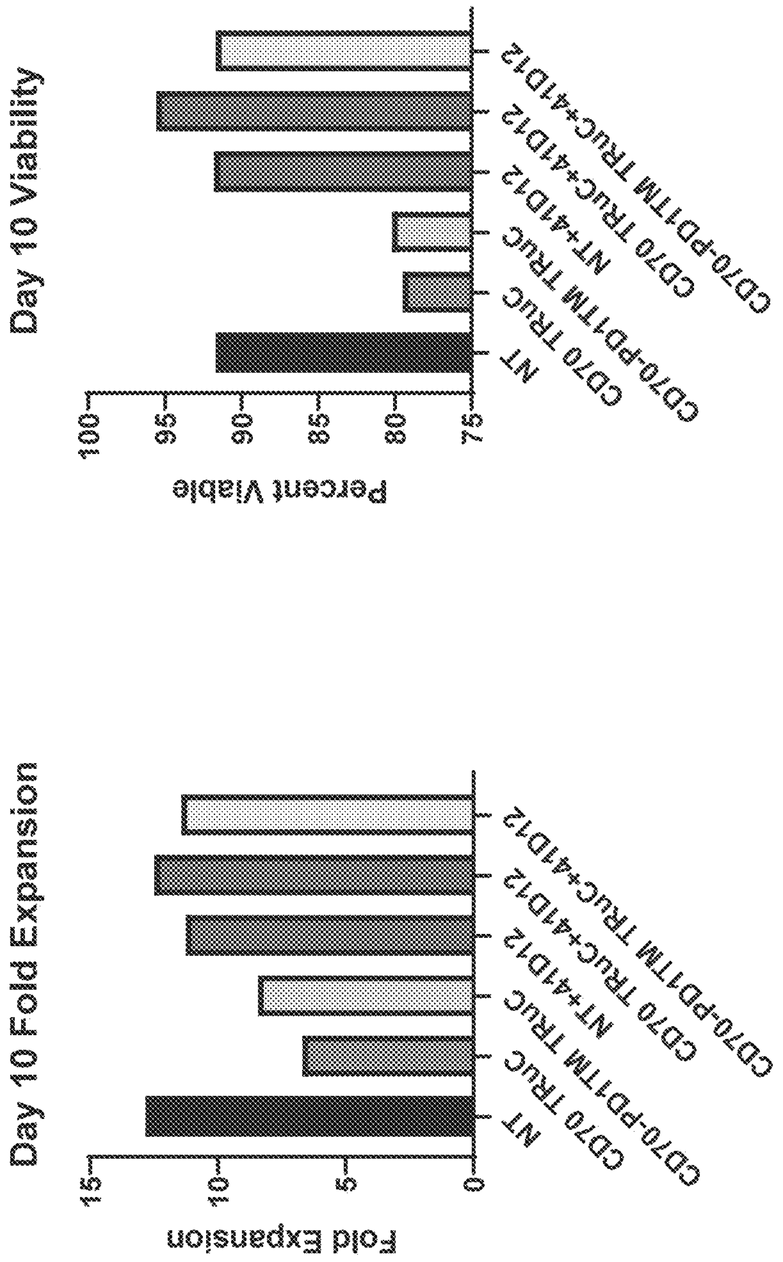
FIG. 13 provides a series of graphs showing expansion and viability of T cells transduced with the TFPs shown and untransduced controls produced according to the methods described in Example 9 in the presence and absence of anti-CD70 antibody after 10 days of expansion.

Expansion is shown in FIG. 13. Cell expansion is increased in the presence of 41D12 for cells transduced with each of the TFPs. FIG. 13 also shows increased viability for cells transduced with each of the TFPs and expanded in the presence of 41D12.

Verification of TFP Expression by Cell Staining

Figure 14:
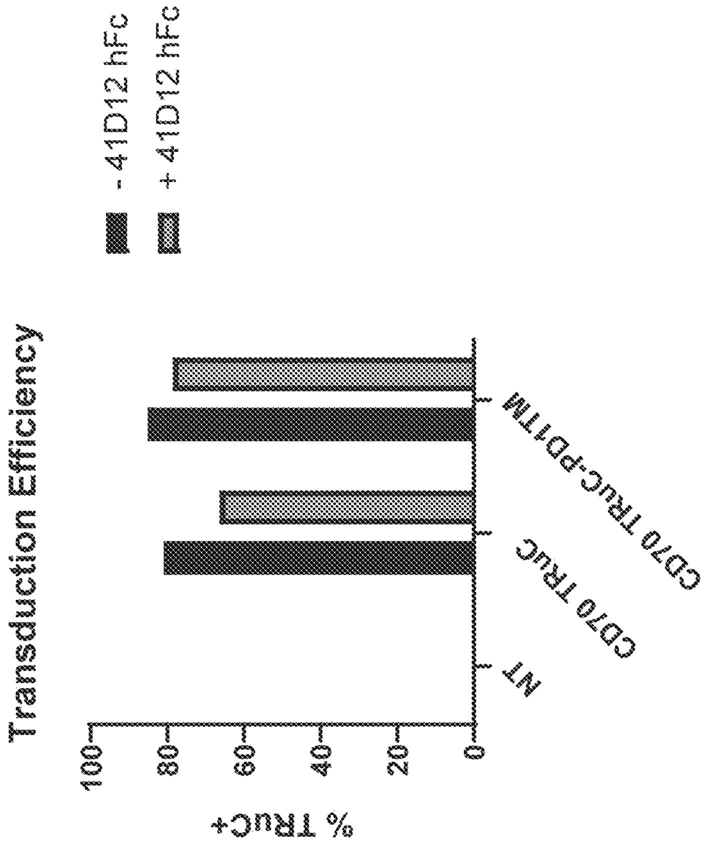
FIG. 14 shows a graph illustrating the transduction efficiency of cells transduced according to the methods described in Example 9 in the presence and absence of anti-CD70 antibody with the TFPs shown.

Following lentiviral transduction, expression of TFPs by transduced T cells was confirmed by flow cytometry, using an anti-VHH antibody, on day 10 of cell expansion. T cells were washed three times in PBS and then re-suspended in PBS at $2\times10^5$ cells per well. For dead cell exclusion, cells were incubated with LIVE/DEAD® Fixable Blue Dead Cell Stain (Invitrogen) for 30 minutes at 4° C. in the dark. Cells were then washed twice with PBS and blocked with human FcR Blocking Reagent (Miltenyi Biosciences) for 20 minutes. Cells were then incubated with an iFluor488-conjugated anti-VHH antibody (GenScript) and a BV605-conjugated anti-CD3 antibody (Biolegend) in BD Horizon Brilliant Stain buffer (BD Biosciences) for 30 minutes at 4° C. in the dark. Cells were then washed twice with FACS buffer (PBS with 2% FBS) and then fixed in a solution of PBS and 4% formaldehyde for 20 mins at 4° C. in the dark. Cells were then washed twice and resuspended with FACS buffer (PBS with 2% FBS) and submitted to data acquisition on LSR Fortessa™-$X_{20}$ (BD Biosciences) using FACS Diva software. The TFP expression was analyzed, with FlowJo® (BD Biosciences), from live T cells (CD3+ alive cells). As is shown in FIG. 14 binding of the anti-VHH antibody was detected in all of the TFP transduced T cells, indicating cell surface expression of the TFP.

Phenotyping of TFP T Cells

Phenotyping of the TFP transduced T cells was assess by flow cytometry and is presented graphically. TFP T cells or non-transduced T cells were generated as described above. At day 10 of expansion, T cells were harvested and the cells were characterized by flow cytometry with antibodies having the following tags. The proportion of CD4+ to CD8+ T cells was determined by flow cytometry with APC-Cy7 (to detect CD4+) and PerCP-Cy5.5 (to detect CD8+) (FIG. 15).

Figure 16A:
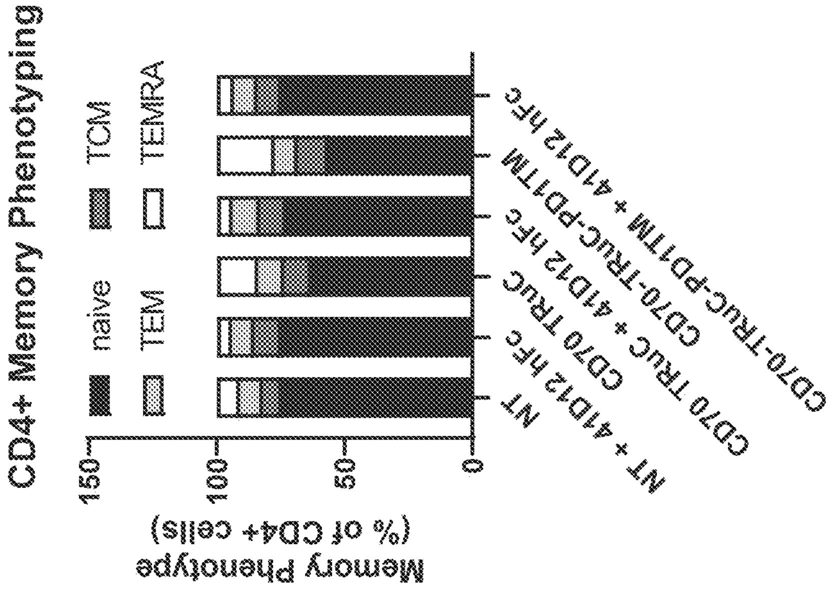
FIGS. 16A and 16B are a series of graphs illustrating the memory phenotype of T cells when TFP+ T cells are generated according to the methods described in Example 9 in the presence and absence of anti-CD70 antibody.
Figure 16B:
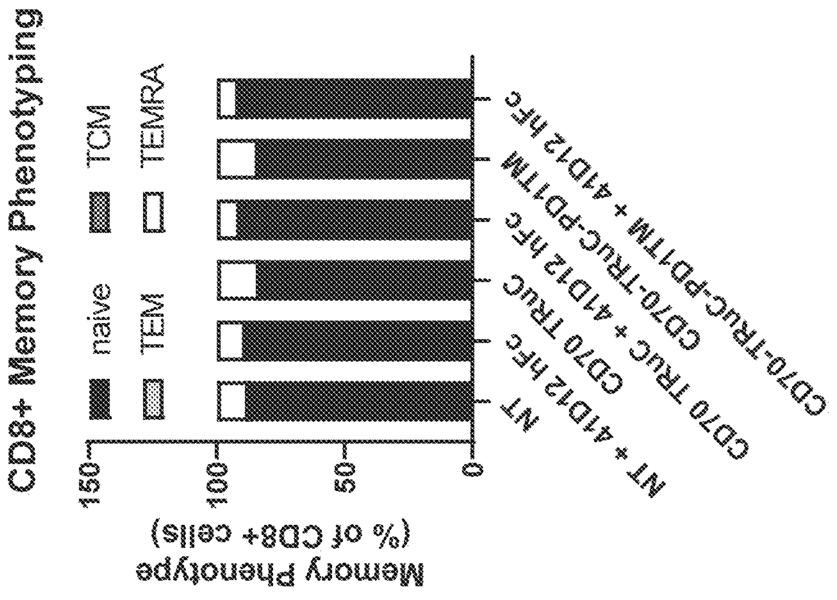
Figure 17:
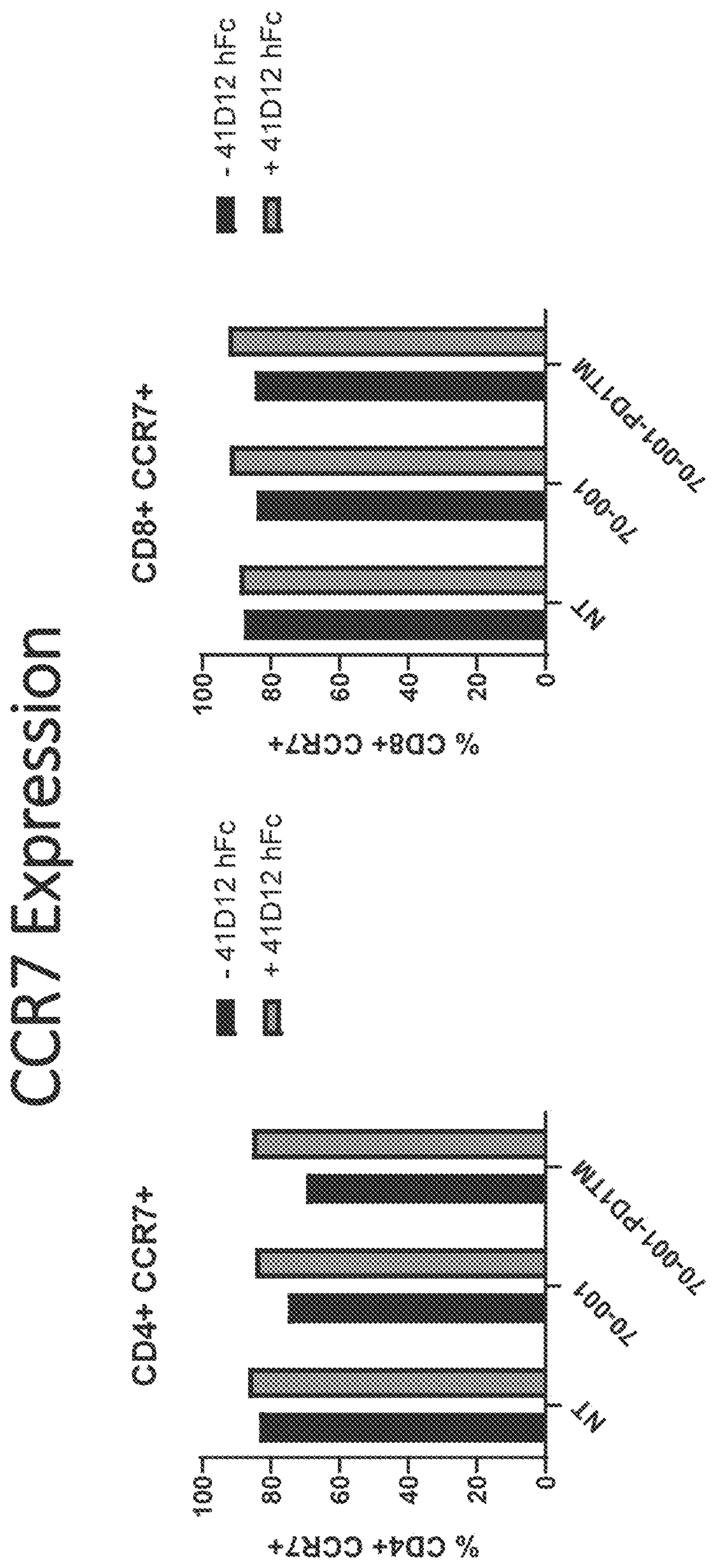
FIG. 17 provides a series of graphs showing the proportion of CCR7+ CD4+ and CD8+ T cells when TFP+ T cells are generated according to the methods described in Example 9 in the presence and absence of anti-CD70 antibody.
Figure 18:
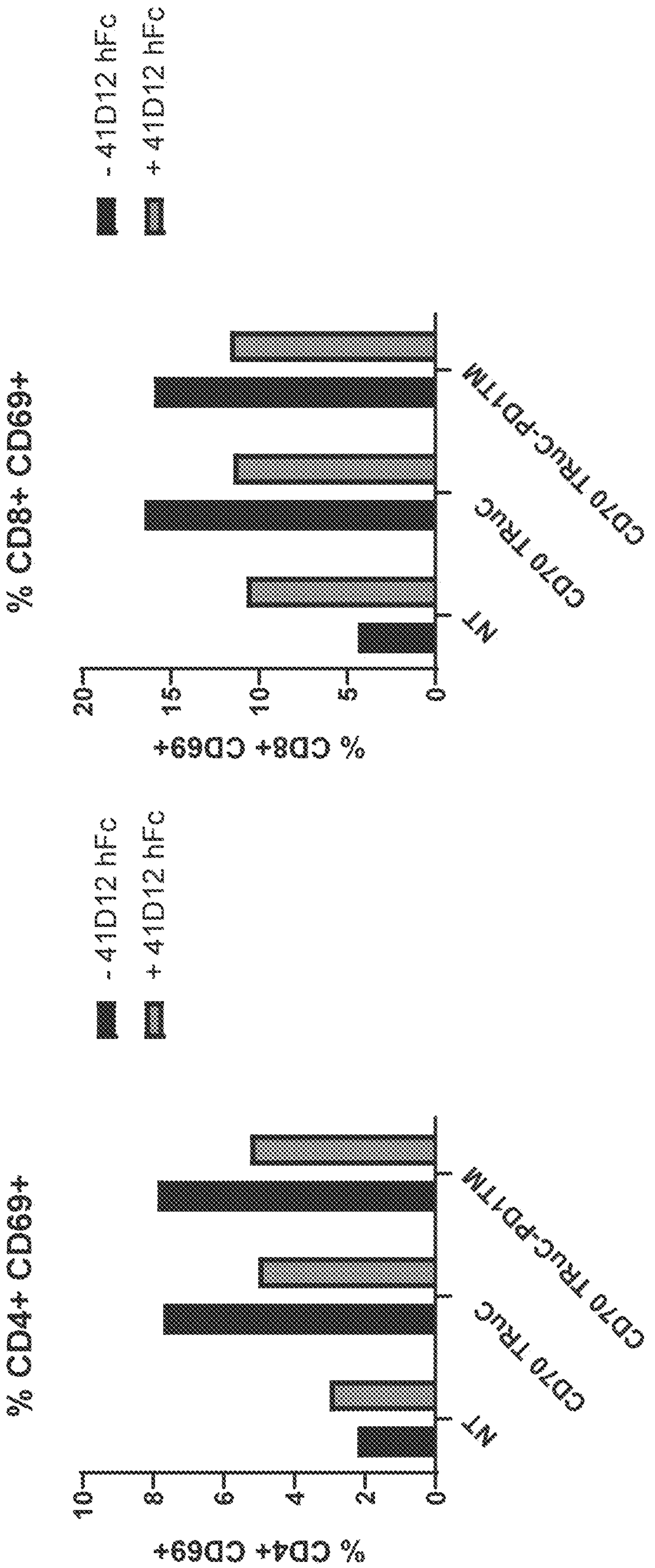
FIG. 18 provides a series of graphs showing the proportion of CCR69+ CD4+ and CD8+ T cells when TFP+ T cells are generated according to the methods described in Example 9 in the presence and absence of anti-CD70 antibody.
Figure 19A:
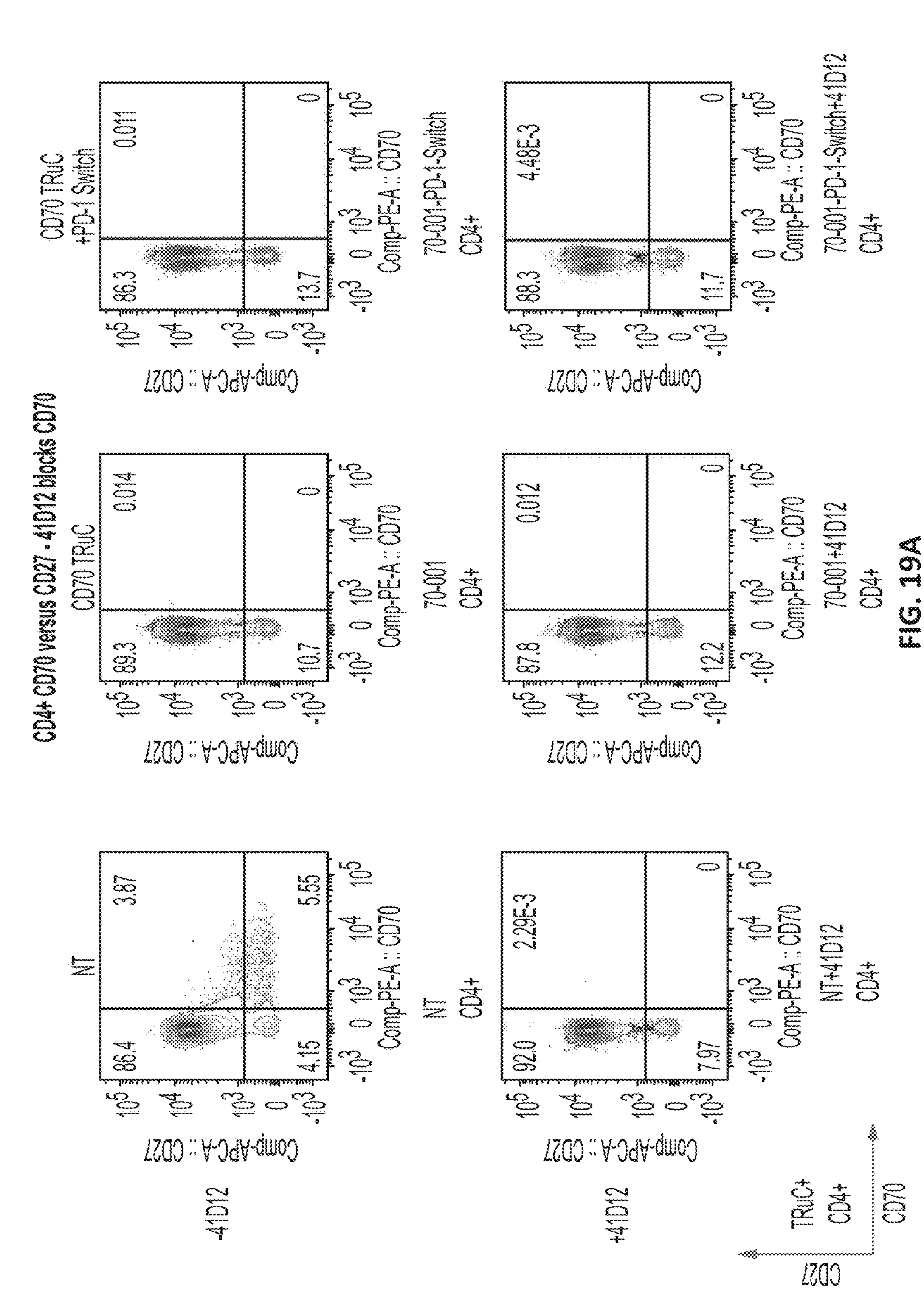
FIGS. 19A and 19B are a series of graphs illustrating the proportion of CD27+ and CD70+ T cells when TFP+ T cells are generated according to the methods described in Example 9 in the presence and absence of anti-CD70 antibody.
Figure 19B:
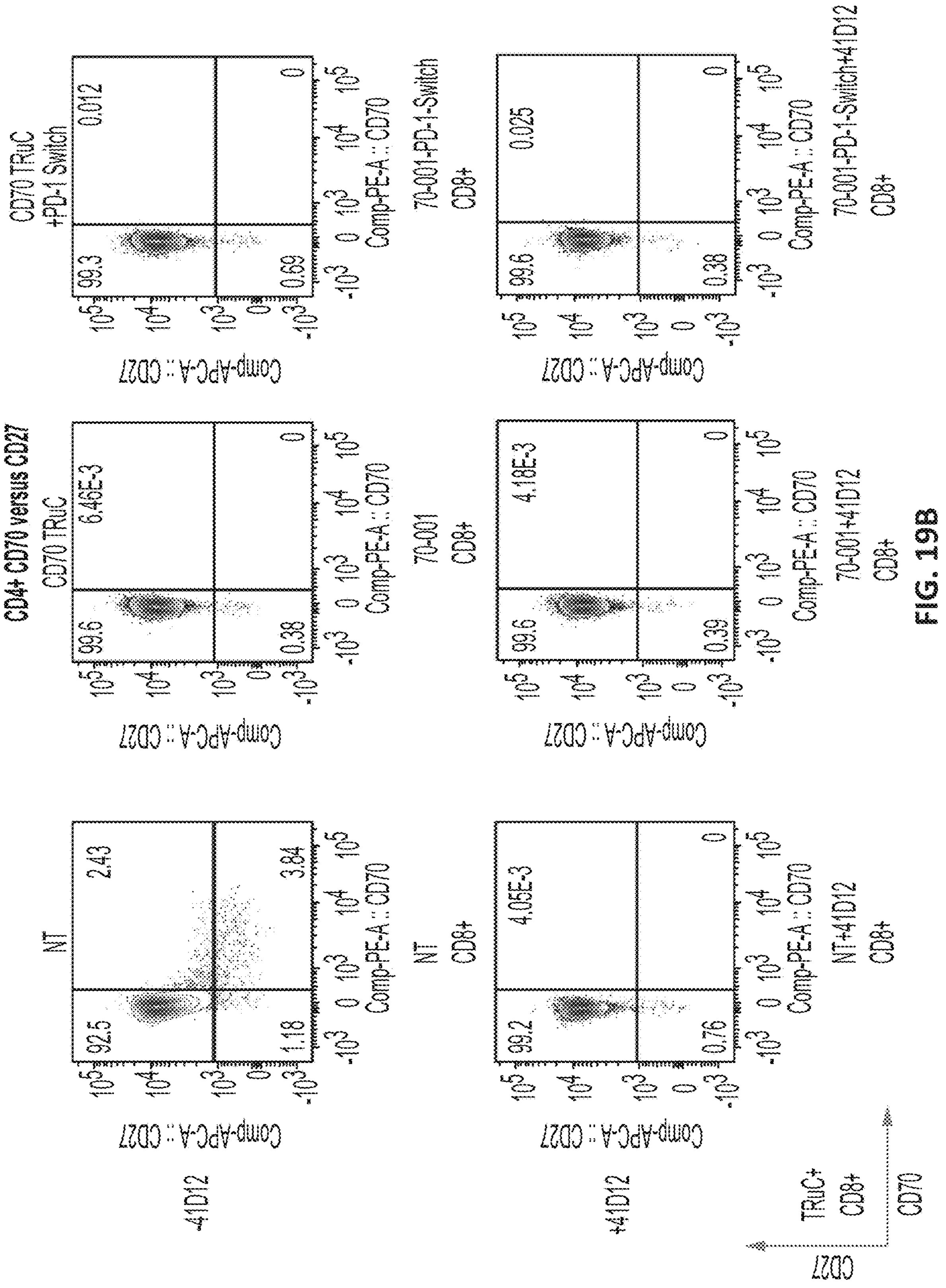

The memory status of the T cells was determined by flow cytometry with BV786 (to detect CD45RA) and BV421 (to detect CCR7) in CD4+ T cells (FIG. 16A) and in CD8+ T cells (FIG. 16B). FIG. 17 shows CCR7 levels. FIG. 18 show the proportion of CD69+(PECy7) cells in CD4+ and CD8+ T cells. FIGS. 19A and 19B show CD27 (APC) staining against CD70 (PE) in CD4+ and CD8+ T cells.

Figure 15:
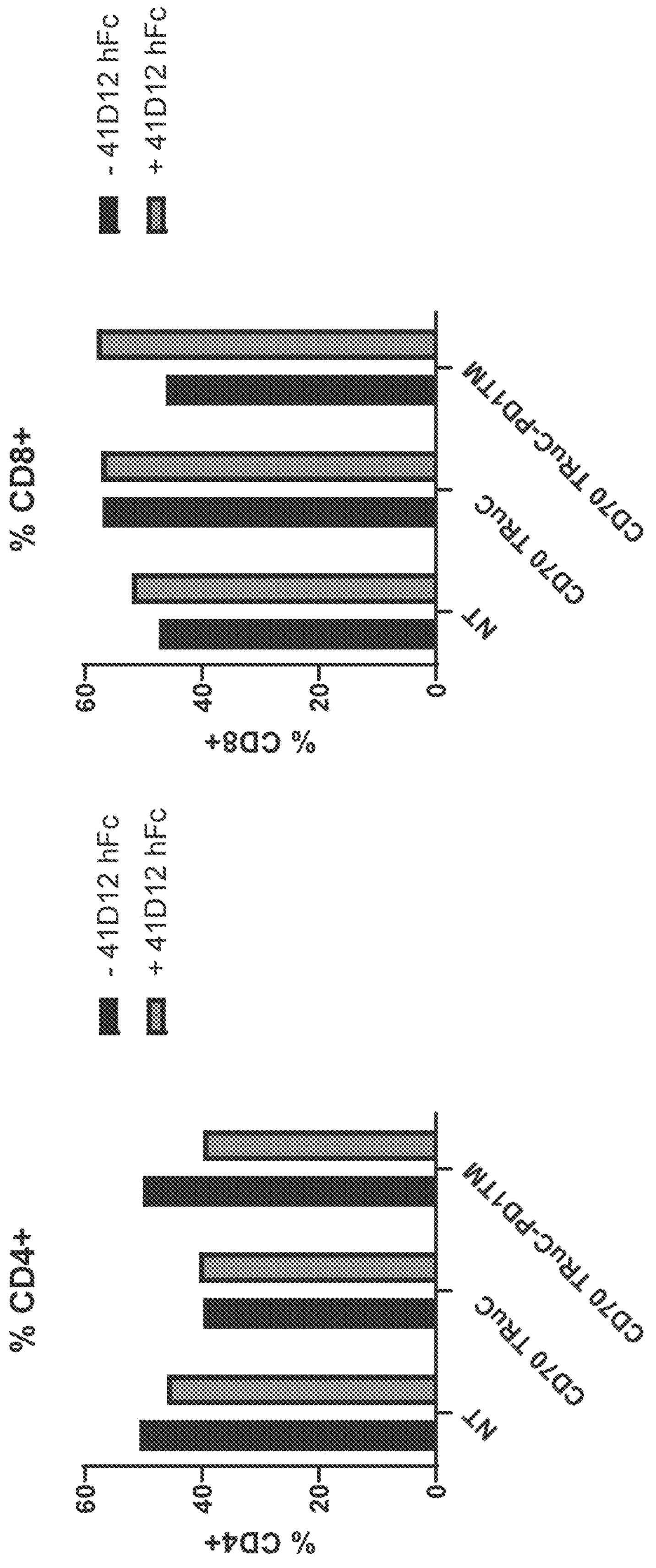
FIG. 15 provides a series of graphs showing the proportion of CD4+ and CD8+ T cells when TFP+ T cells are generated according to the methods described in Example 9 in the presence and absence of anti-CD70 antibody.

As is shown in FIG. 15, the proportion of CD4+ and CD8+ cells was similar in TFP+ cells treated with anti-CD70 antibody relative to untreated cells.

As is shown in FIGS. 16A and 16B, CD70.TFP+ T cells and CD70.TFP+ T cells having the PD-1 switch treated with the anti-CD70 antibody display an increased level of naïve-like cells and decreased TEMRA cells relative to untreated cells for both CD4+ and CD8+ T cells. As is shown in FIG. 17, CD4+ and CD8+ CD70.TFP+ T cells and CD70.TFP+ T cells having the PD-1 switch showed a modest increase in CCR7 levels when treated with the 41D12 antibody relative to untreated cells. As is shown in FIG. 18, CD4+ and CD8+ CD70.TFP+ T cells and CD70.TFP+ T cells having the PD-1 switch showed an increase in CD69 levels when treated with the 41D12 antibody relative to untreated cells. These results suggest that treatment with an anti-CD70 antibody during expansion promotes a naïve or central memory phenotype in TFP+ T cells.

FIGS. 19A and 19B demonstrate that the antibody block detection of CD70 at the cell surface of nontransduced cells and all TFP+ T cells, including CD70.TFP+ T cells with and without the PD-1 switch.

RNA-Seq

Figure 20:
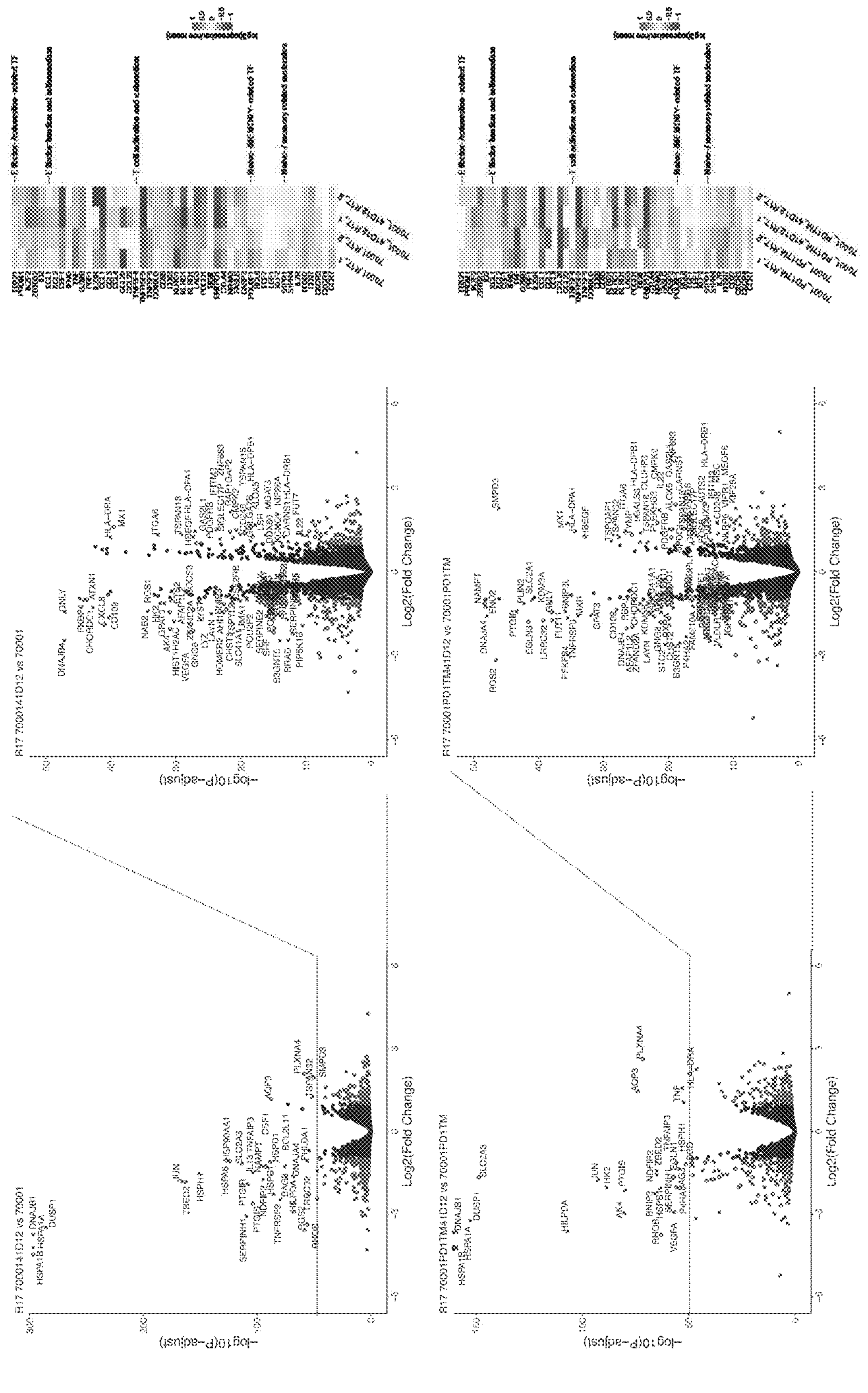
FIG. 20 is a series of plots illustrating RNAseq on TFP+ T cells generated according to the methods described in Example 9 in the presence and absence of anti-CD70 antibody.

RNA-seq was also done on cells prepared according to the methods described herein. RNA was generated from CD70.TFP+ T cells with and without the PD-1 switch generated in the presence or absence of 41D12 antibody after 10 days of expansion. The results of the analysis are shown in FIG. 20. For CD70.TFP+ T cells with and without the PD-1 switch, an upregulation of genes involved in naïve/memory related phenotype and a downregulation of genes involved in effector/exhaustion phenotypes is seen for cells generated in the presence of the anti-CD70 antibody relative to those generated in the absence of the anti-CD70 antibody.

Cytotoxicity and Cytokine Production of T Cells Generated with Anti-CD70 Antibody The luciferase-based cytotoxicity assay assesses the cytotoxicity of TFP T cells by indirectly measuring the luciferase enzymatic activity in the residual live target cells after co-culture. CD70– negative K562 cells, CD70-positive THP-1 AML cells, and CD70-positive RCC 786-O cells were modified to overexpress firefly luciferase via transduction with firefly luciferase encoding lentivirus followed with antibiotic selection to generate stable cell line.

The target cells were plated at 10000 cells per well in 96-well plate. The TFP transduced or non-transduced T cells were added to the target cells at different effector-to-target ratios (9:1, 3:1 or 1:1). The mixture of cells was then cultured for 24 or 72 hours (at a 1:1 ratio only) at 37° C. with 5% $CO_2$ before the luciferase enzymatic activity in the live target cells was measured by the Bright-Glo® Luciferase Assay System (Promega®, Catalogue number E2610). The cells were spun into a pellet and resuspended in medium containing the luciferase substrate. The percentage of tumor cell killing was then calculated with the following formula: % Cytotoxicity=100%×[1−RLU (Tumor cells+T cells)/RLU (Tumor cells)].

Figure 21:
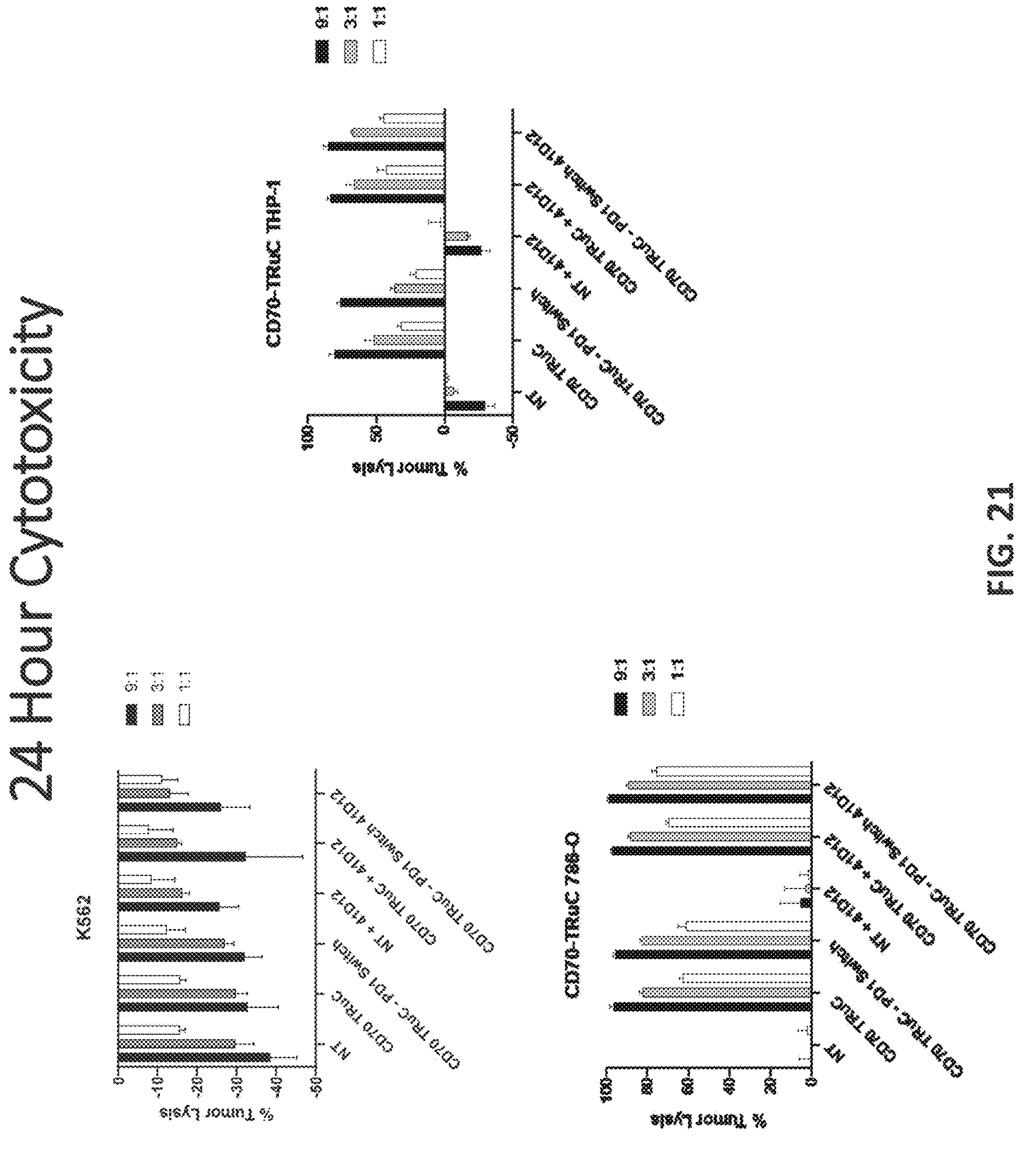
FIG. 21 is a series of graphs illustrating the cytotoxicity of TFP+ T cells generated according to the methods described in Example 9 in the presence and absence of anti-CD70 antibody. Cells are co-cultured at a target:effector ratio of 1:1, 3:1 or 9:1 CD70-negative K562 cells, CD70-positive THP-1 AML cells, or CD70-positive RCC 786-O cells were modified to overexpress firefly luciferase and cell lysis is determined by luciferase activity of live cells.
Figure 22A:
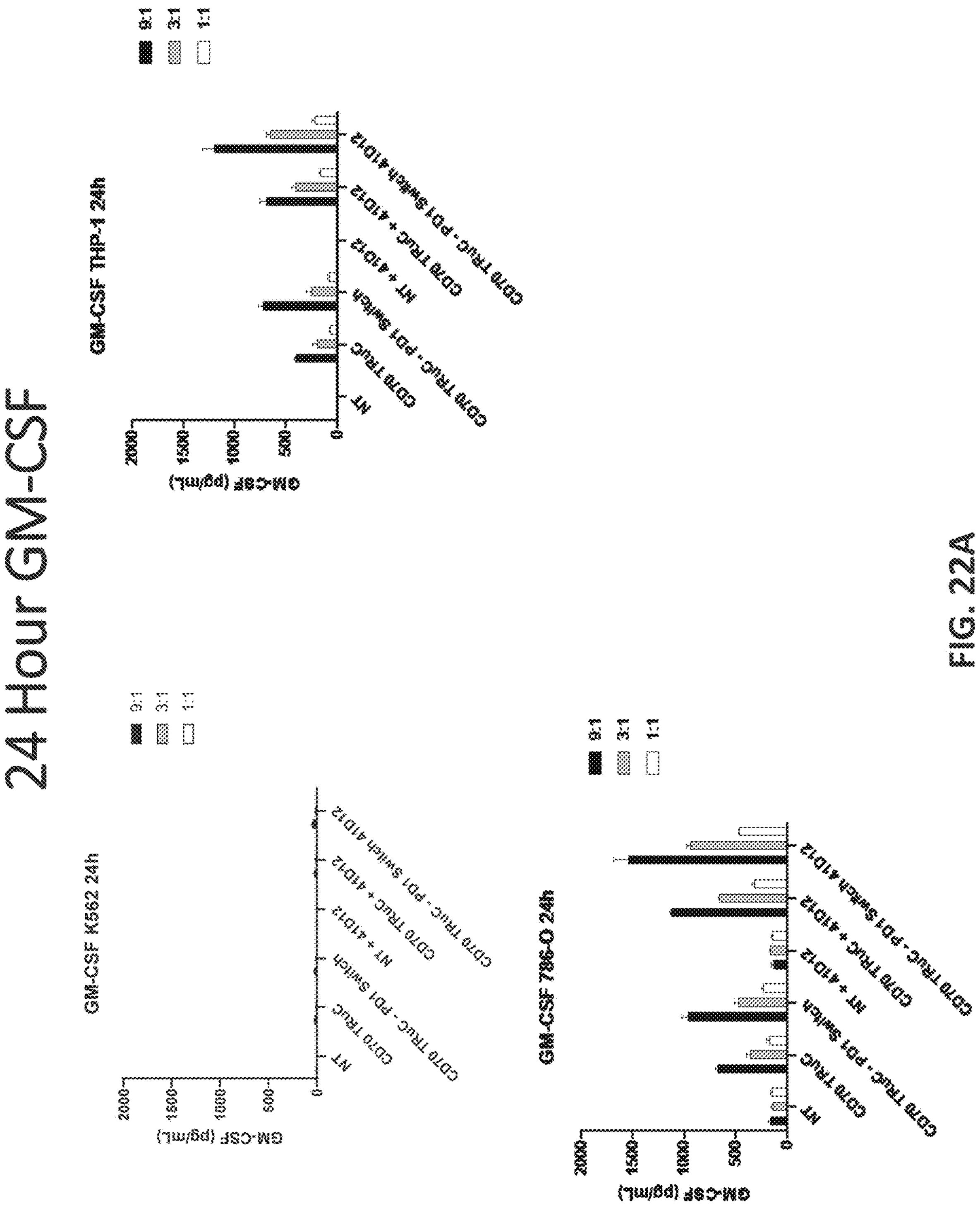
FIGS. 22A-22H are a series of graphs illustrating cytokine expression by the TFP+ T cells shown when co-cultured with CD70-negative K562 cells, CD70-positive THP-1 AML cells, or CD70-positive RCC 786-O cells at a target:effector ratio of 1:1, 3:1 or 9:1 for 24 or 72 hours. TFP+ T cells were generated according to the methods described in Example 9 in the presence and absence of anti-CD70 antibody. GM-CSF levels are shown at 24 hours (FIG. 22A) and 72 hours (FIG. 22B). IFN-γ levels are shown at 24 hours (FIG. 22C) and 72 hours (FIG. 22D). IL-2 levels are shown at 24 hours (FIG. 22E) and 72 hours (FIG. 22F). TNF-α levels are shown at 24 hours (FIG. 22G) and 72 hours (FIG. 22H).
Figure 22B:
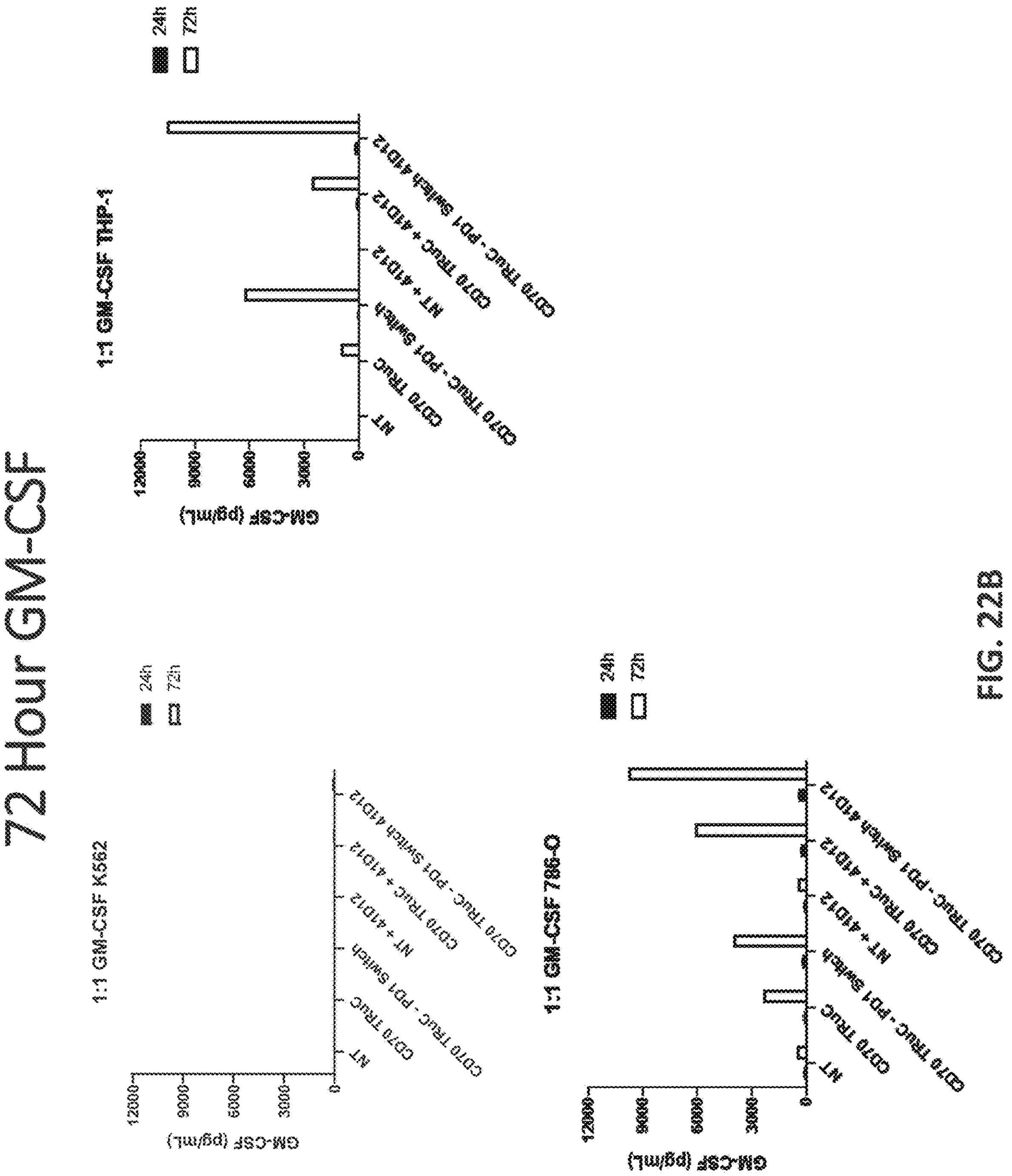
Figure 22C:
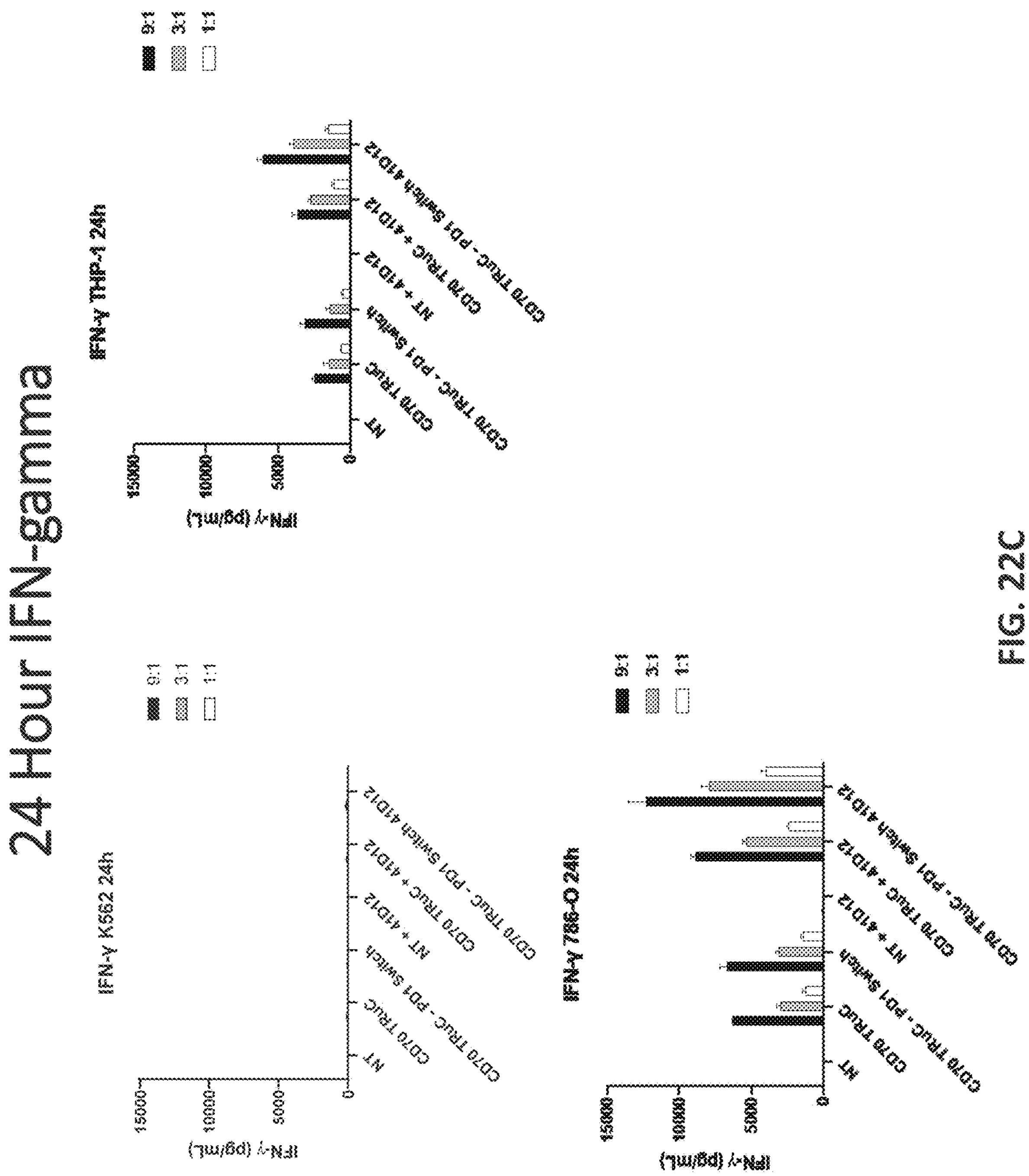
Figure 22D:
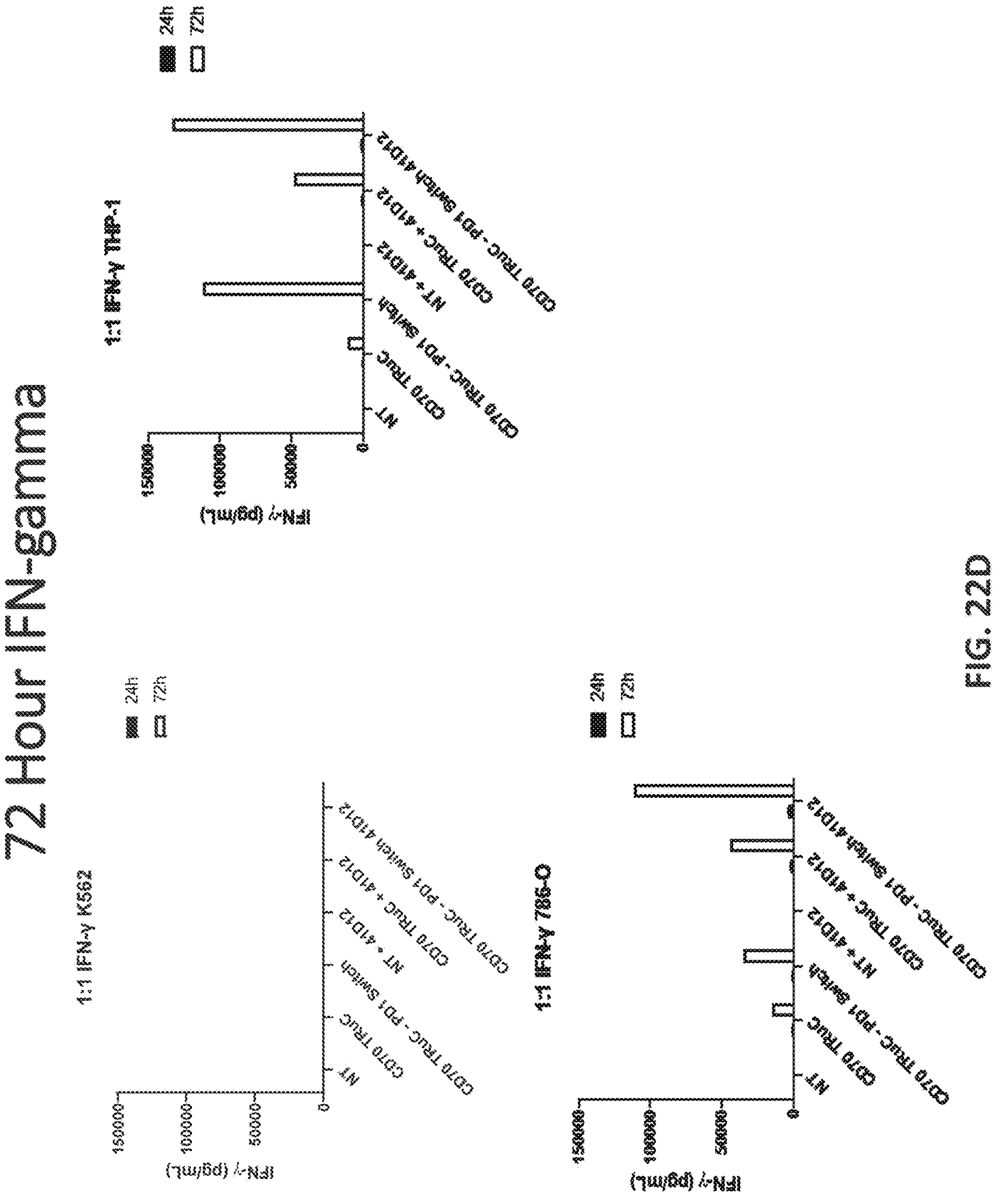
Figure 22E:
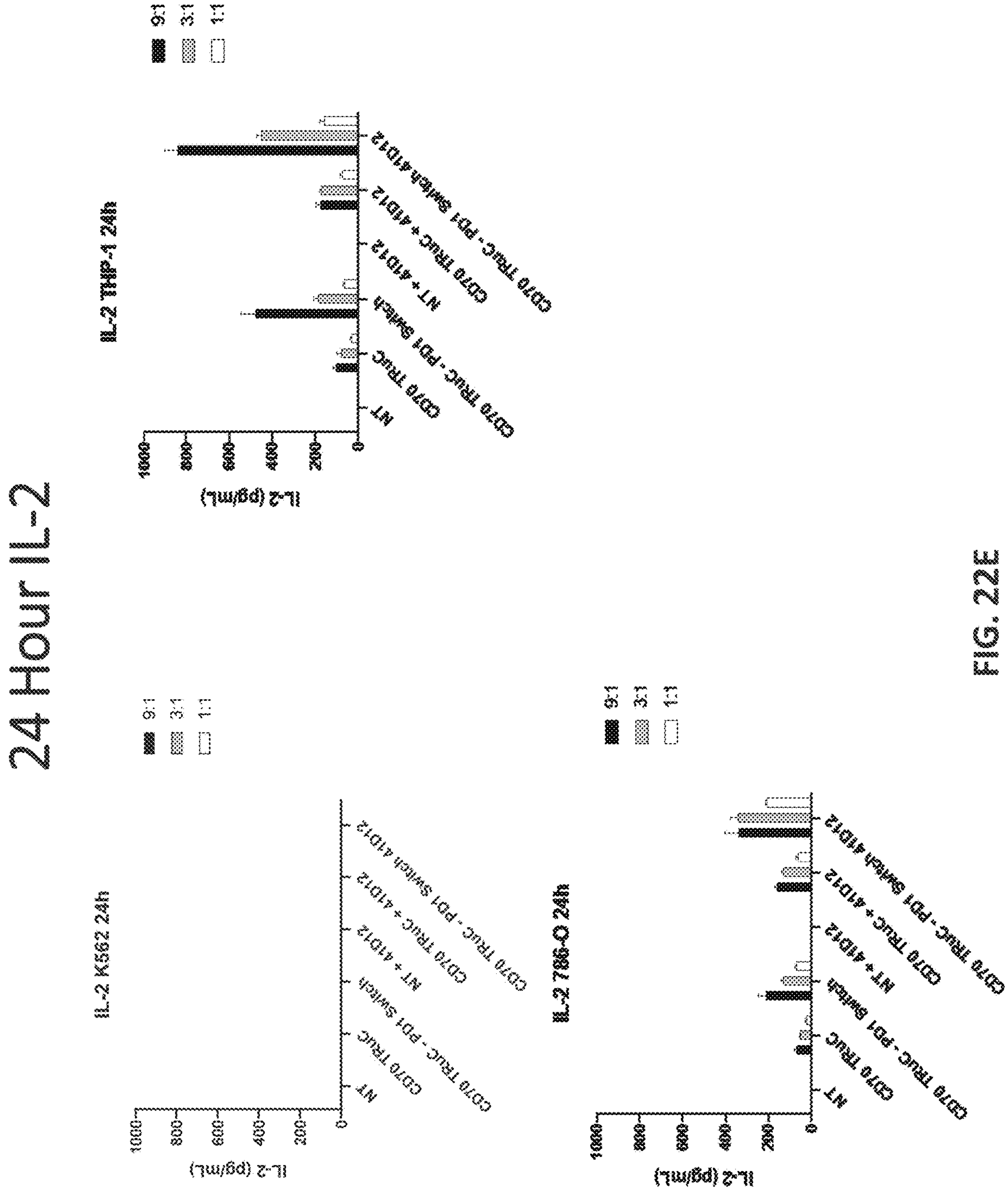
Figure 22F:
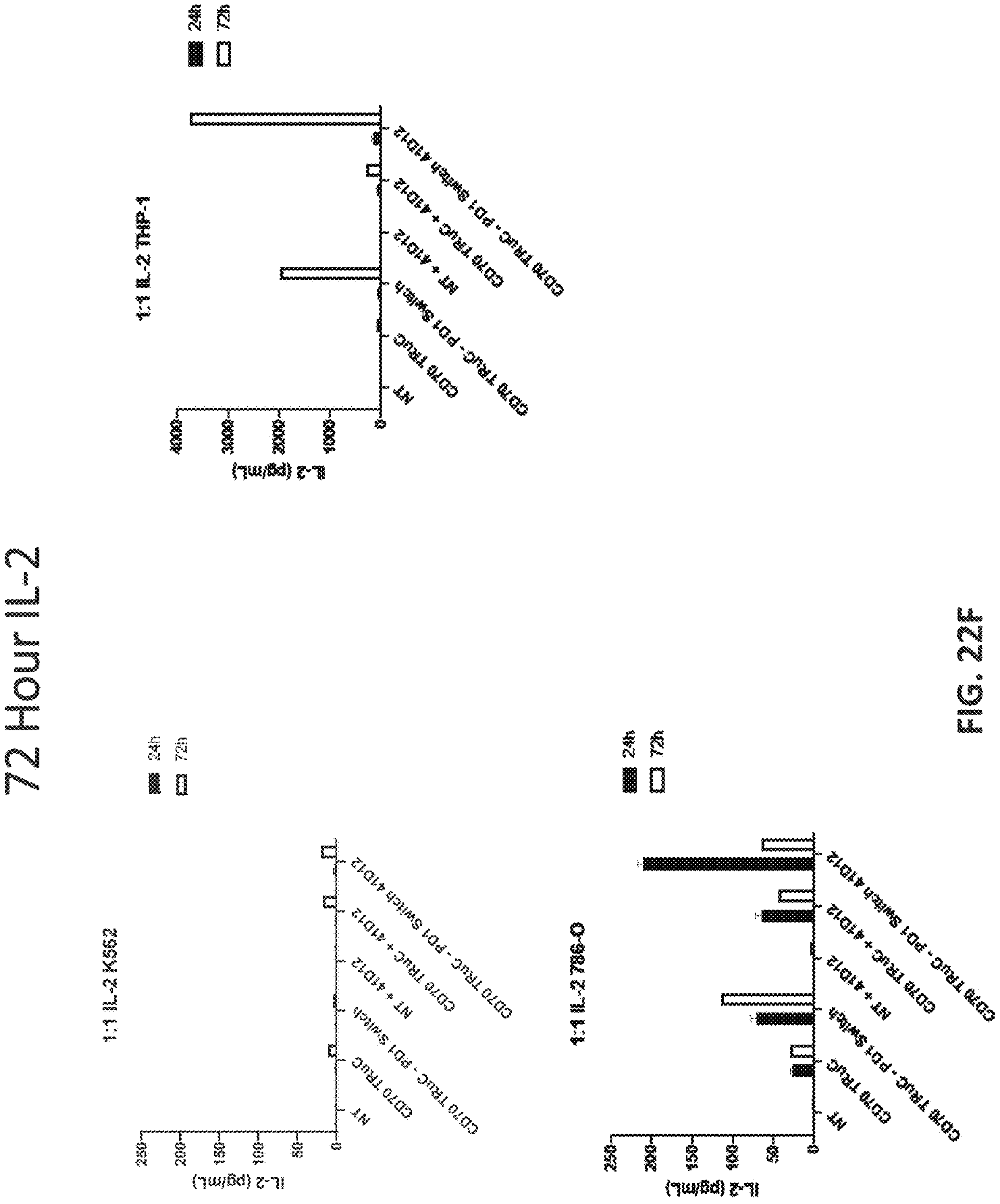
Figure 22G:
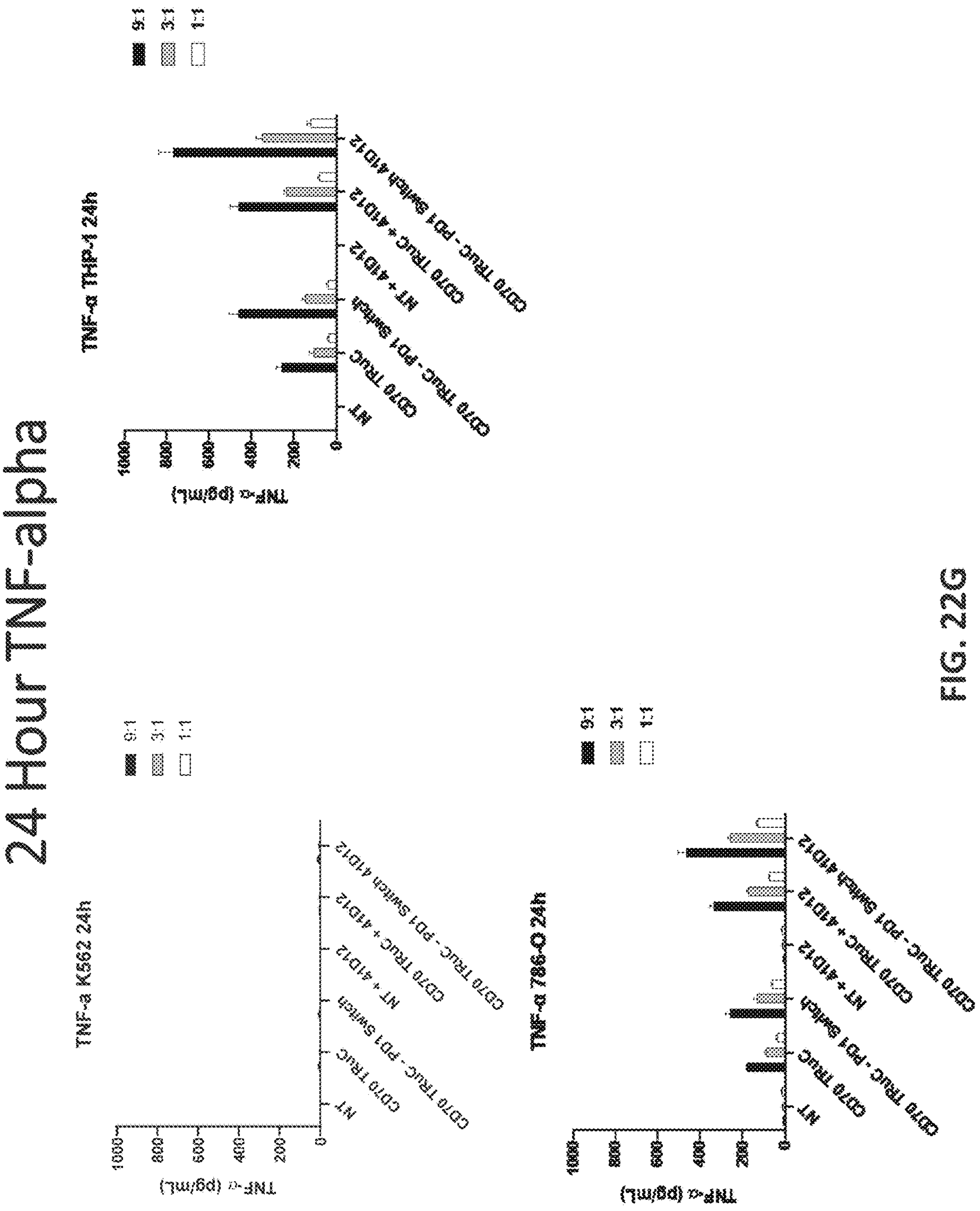
Figure 22H:
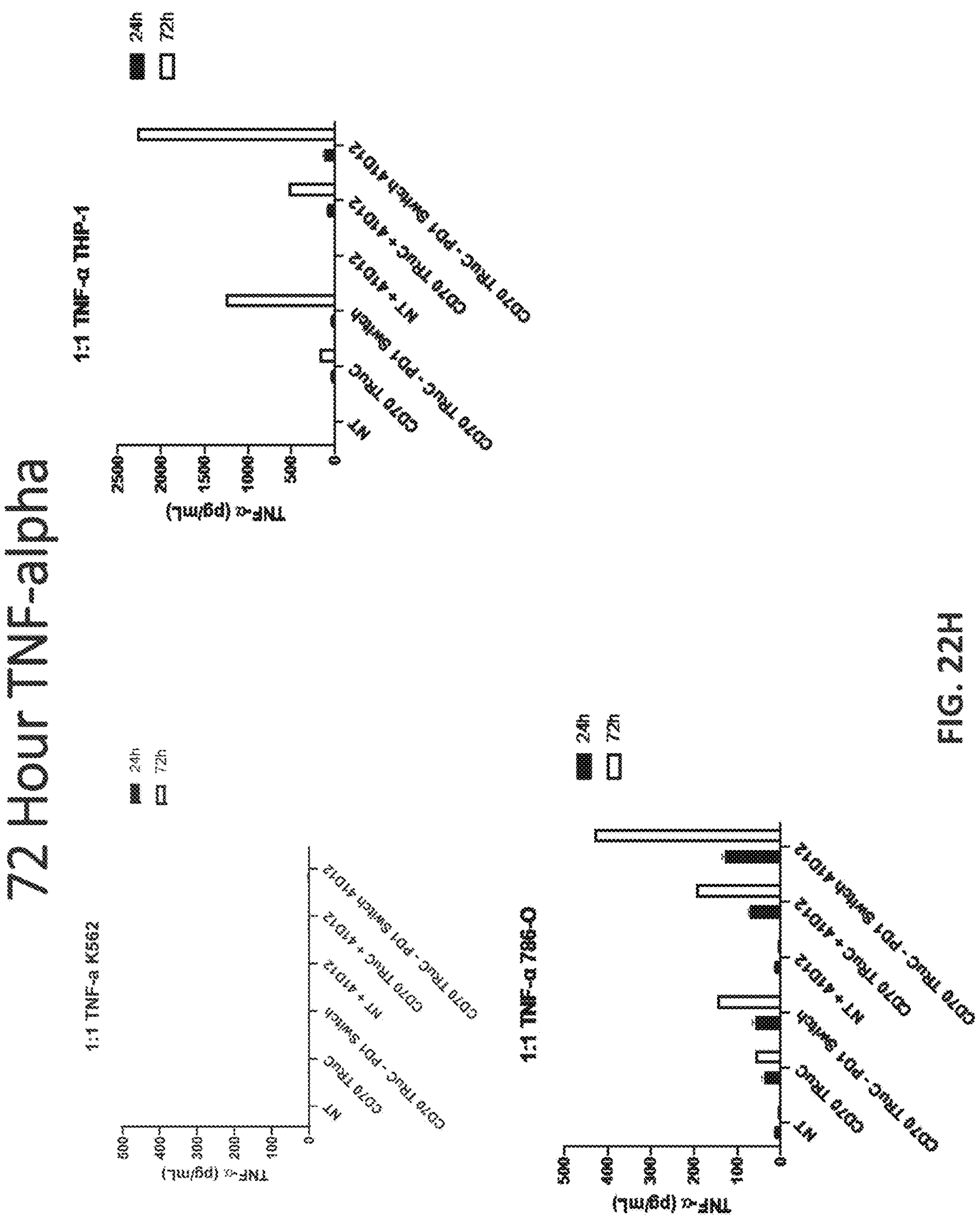

As is shown in FIG. 21, after 24 hours of co-culture, CD70.TFP transduced T cells and CD70-TFP-PD-1 switch transduced TFP cells demonstrated enhanced cytotoxicity towards CD70– positive THP-1 and 786-O cells when expanded in the presence of an anti-CD70 antibody relative to cells expanded in the absence of a CD70 antibody, particularly at 3:1 and 1:1 ratios of effector:target cells, indicating that treatment with an anti-CD70 antibody during expansion increases TFP+ T cell cytotoxicity. The results presented herein may indicate that the TFP+ T cells have increased cytotoxicity due to decreased fratricide during the generation of the CD70 TFP T cells.

Supernatants were taken from the same co-culture assays after 24 hours or 72 hours to assess T cell production of the following cytokines: GM-CSF, IFNγ, IL2, and TNFα. Cytokine production was analyzed using Meso Scale Discovery Technology (MesoScale Diagnostics, LLC), with U-PLEX Biomarker Group I (hu) Assays (Catalog number: K15067L-4.

As is shown in FIGS. 22A-22H, CD70.TFP transduced T cells and CD70-TFP-PD-1 switch transduced TFP cells demonstrated enhanced production of GM-CSF, IFNγ, and TNFα when expanded in the presence of the anti-CD70 antibody when contacted with CD70-expressing THP-1 or 786-O cells at 24 and 72 hours, relative to untreated cells, with the exception of the 72 hour timepoint for the 786-O cells contacted with CD70-TFP-PD-1 switch transduced TFP cells. These results indicate that treatment with an anti-CD70 antibody during expansion increases cytokine production of TFP+ T cells when activated by a target cell. The results presented herein may indicate that the TFP+ T cells have increased cytotoxicity due to decreased fratricide during the generation of the CD70 TFP T cells.

Example 10: CD70 Knock-Out T Cell Receptor Fusion Protein T Cells

T-Cell Activation, Editing, Transduction, and Expansion

T cells were purified from healthy donor leukopak via positive selection of CD4+ and CD8+ T cells with CD4 and CD8 microbeads from Miltenyi Biotech. On day 0, T cells, freshly isolated or thawed from previously prepared frozen vials, were activated by MACS GMP T cell TransAct (Miltenyi Biotech), in the presence of human IL-7 and IL-15 (both from Miltenyi Biotech, premium grade). On day 1, activated T cells were transduced at $1\times10^6$ cells/mL with lentivirus encoding the CD70.TFP. On day 4, the cells were washed, subcultured in fresh medium with cytokines and then expanded up to day 10 by supplementing fresh medium on day 7 and day 9. At each day of subculture, cells were harvested, washed, and resuspended with fresh cytokine-containing medium to maintain the cell suspension at $0.5\times10^6$ cells/mL.

For CRISPR edited CD70 KO cells, CD70 was inactivated in the T cells described above at day 1 (on the same day as transduction). SpCas9 ribonucleoproteins (RNPs) targeting the CD70 gene was prepared by annealed crRNA targeting CD70 with tracrRNA at a molecular ratio of 1:1. Annealed duplexes were mixed with SpCas9 protein at a molecular ratio of 1.5:1. 0.61 μM of RNPs were mixed with $2.5\times10^6$ T cells and electroporated following the manufacturer's protocol for the Neon Transfection System, electroporation was set at 1600V, 10 ms, 3 pulses. Cells were immediately transferred to warm medium and incubated at 37° C. to allow expansion of edited T cells.

Verification of Editing and TFP Expression by Cell Staining

Figure 23A:
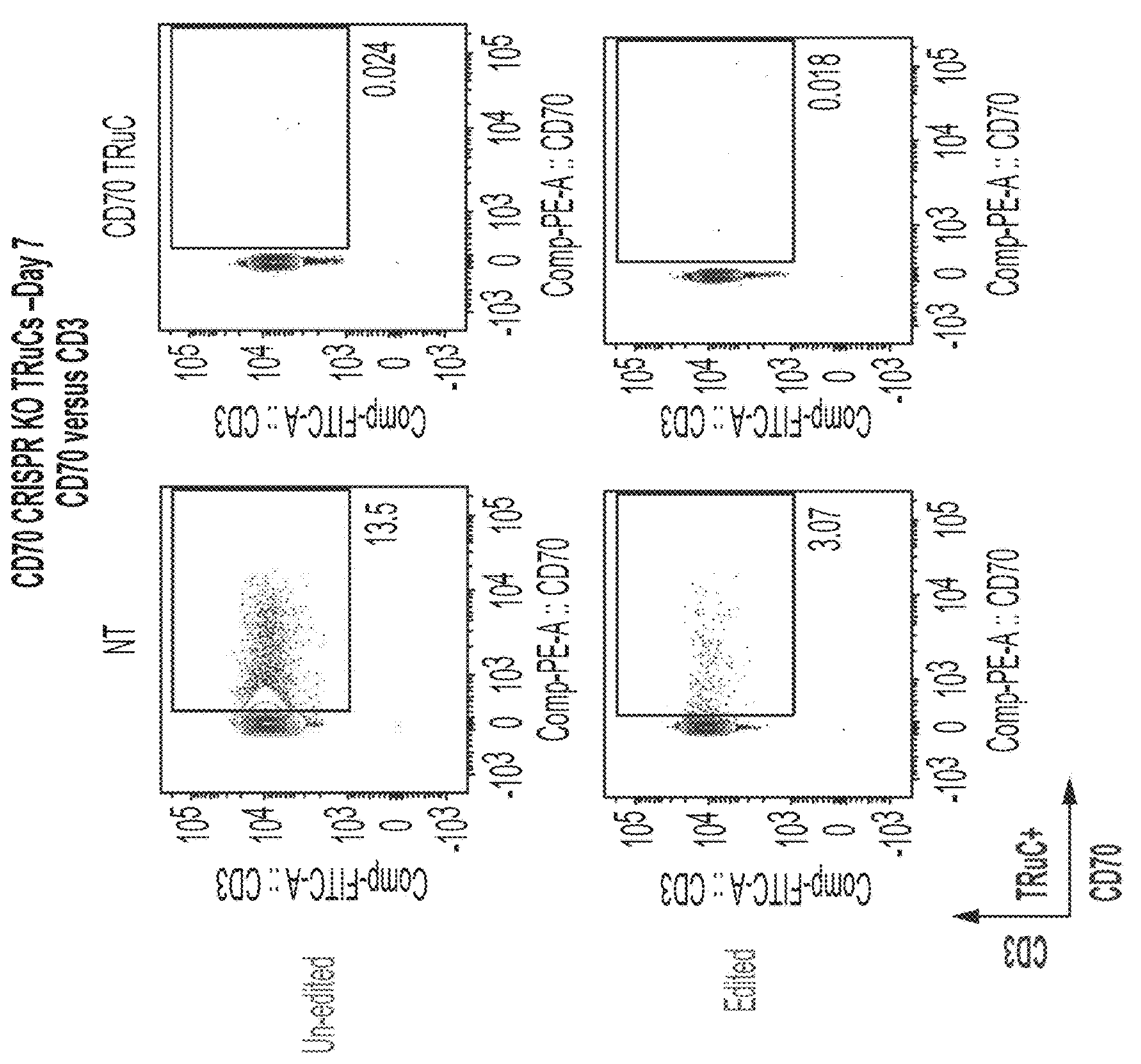
FIGS. 23A and 23B are a series of graphs illustrating the proportion of TFP+ CD70+ and CD70− cells 7 days (FIG. 23A) and 9 days (FIG. 23B) after CRISPR editing to knock out CD70.
Figure 23B:
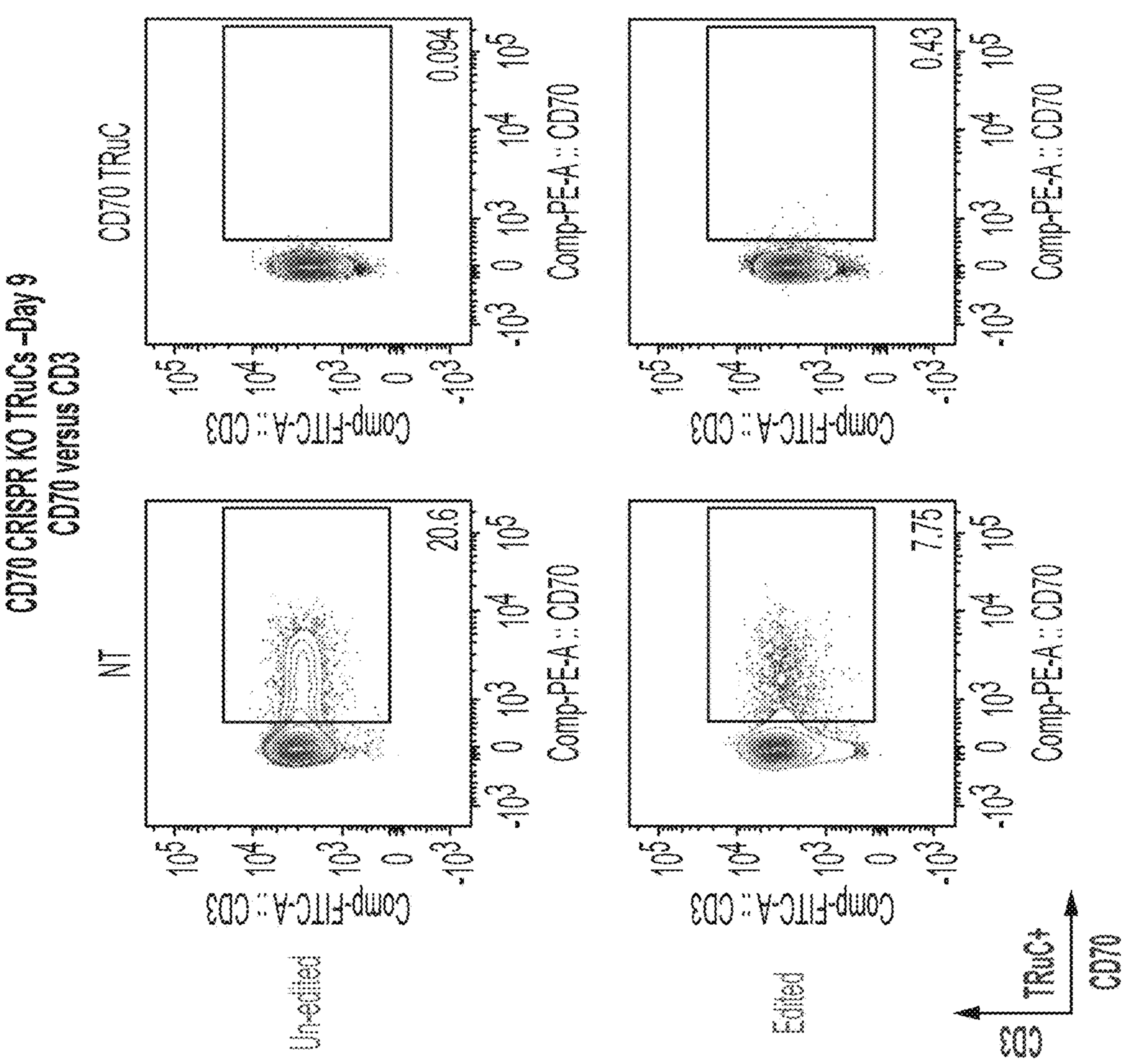

Editing efficacy was assessed by measuring loss of surface expression of CD70 via flow cytometry on days 7 and 9 of cell expansion using PE-conjugated CD70 antibody (Biolegend) and BV605-conjugated anti-CD3 antibody (Biolegend). As is shown in FIGS. 23A and 23B, little CD70 was detected at the cell surface of all edited cell types tested, at both days 7 and 9.

Figure 24:
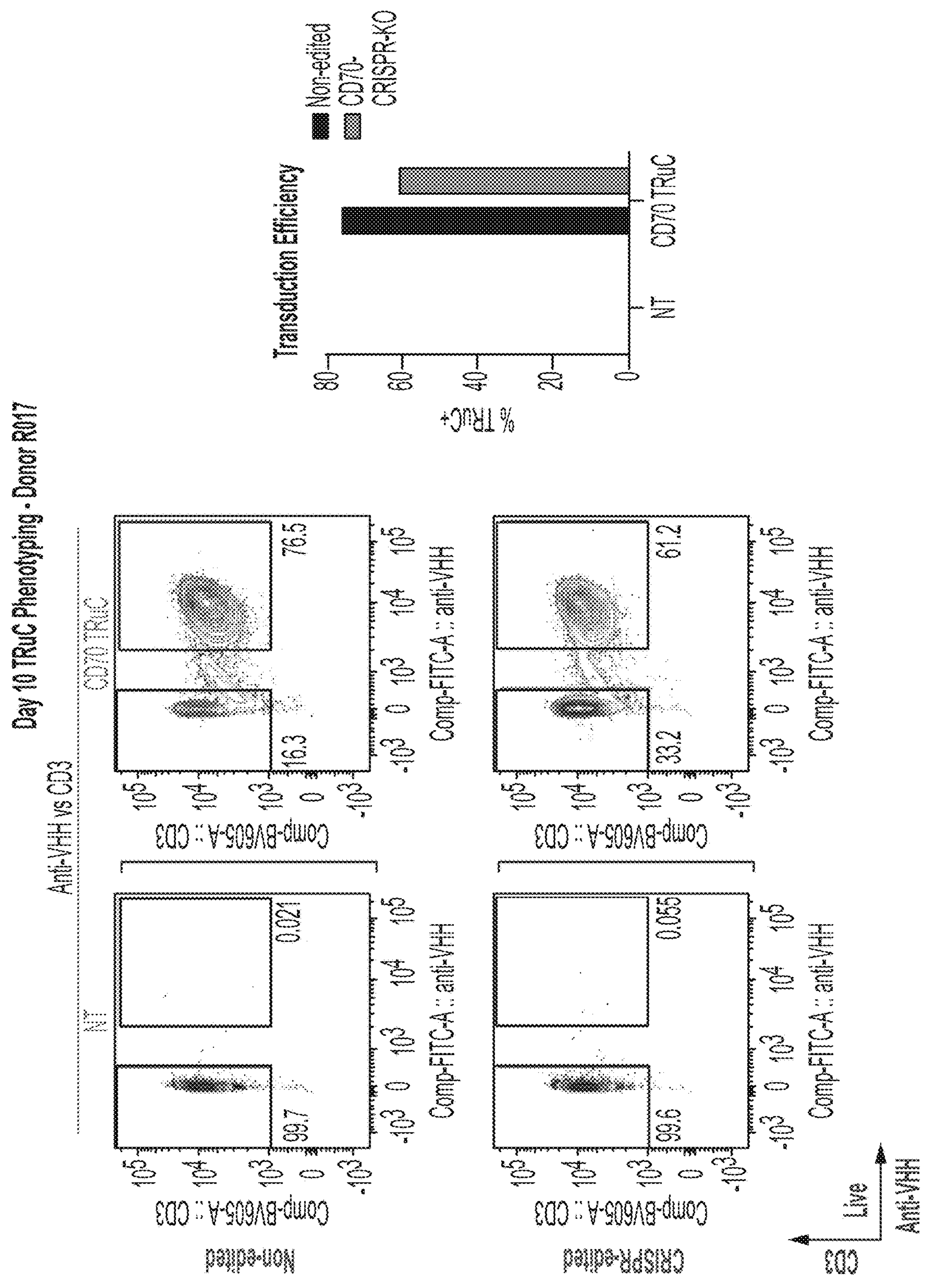
FIG. 24 shows a graph and plot illustrating the transduction efficiency of cells transduced with the TFP shown according to the methods described in Example 10 in non-edited and CD70 CRISPR edited cells.

Expression of TFPs by transduced T cells was confirmed by flow cytometry, as described in Example 9, on day 10 of cell expansion. As is shown in FIG. 24 binding of the anti-VHH antibody was detected in all of the TFP transduced T cells, indicating cell surface expression of the TFP, and transduction efficiency was comparable between non-edited and edited cells.

Phenotyping of TFP T Cells

Figure 25:
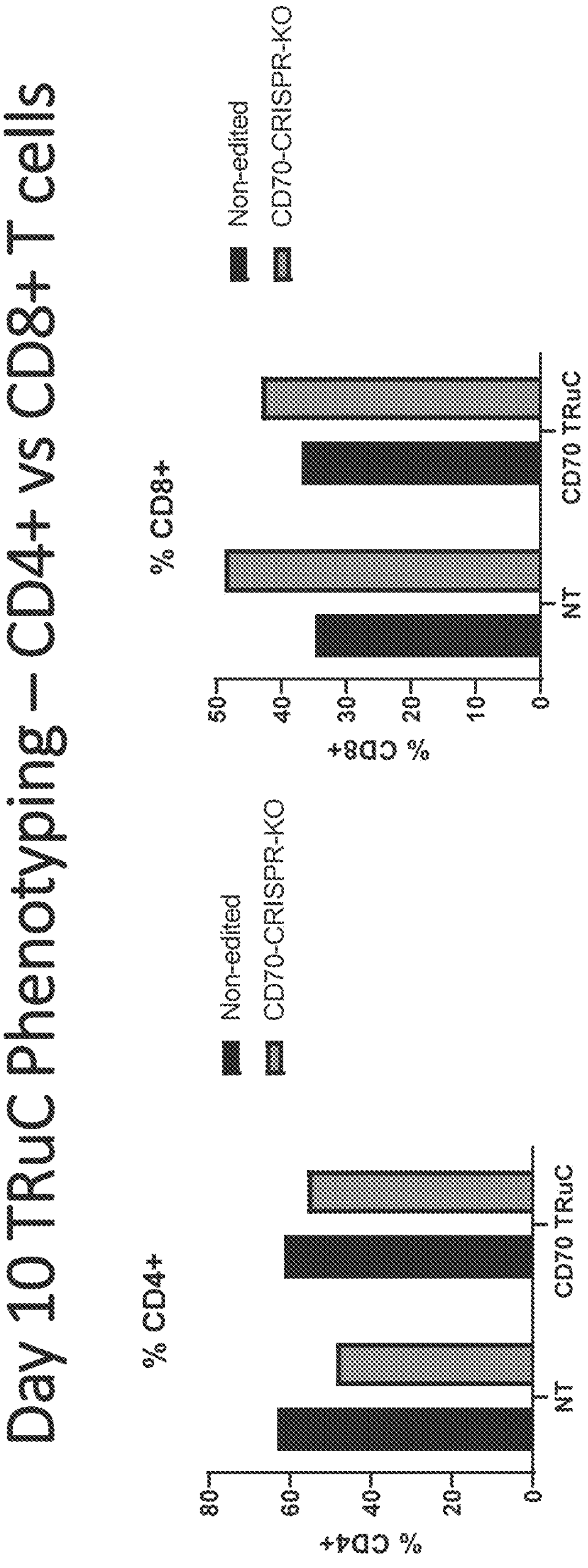
FIG. 25 provides a series of graphs showing the proportion of CD4+ and CD8+ T cells when TFP+ T cells are generated according to the methods described in Example 10 in non-edited and CD70 CRISPR edited cells.
Figure 26:
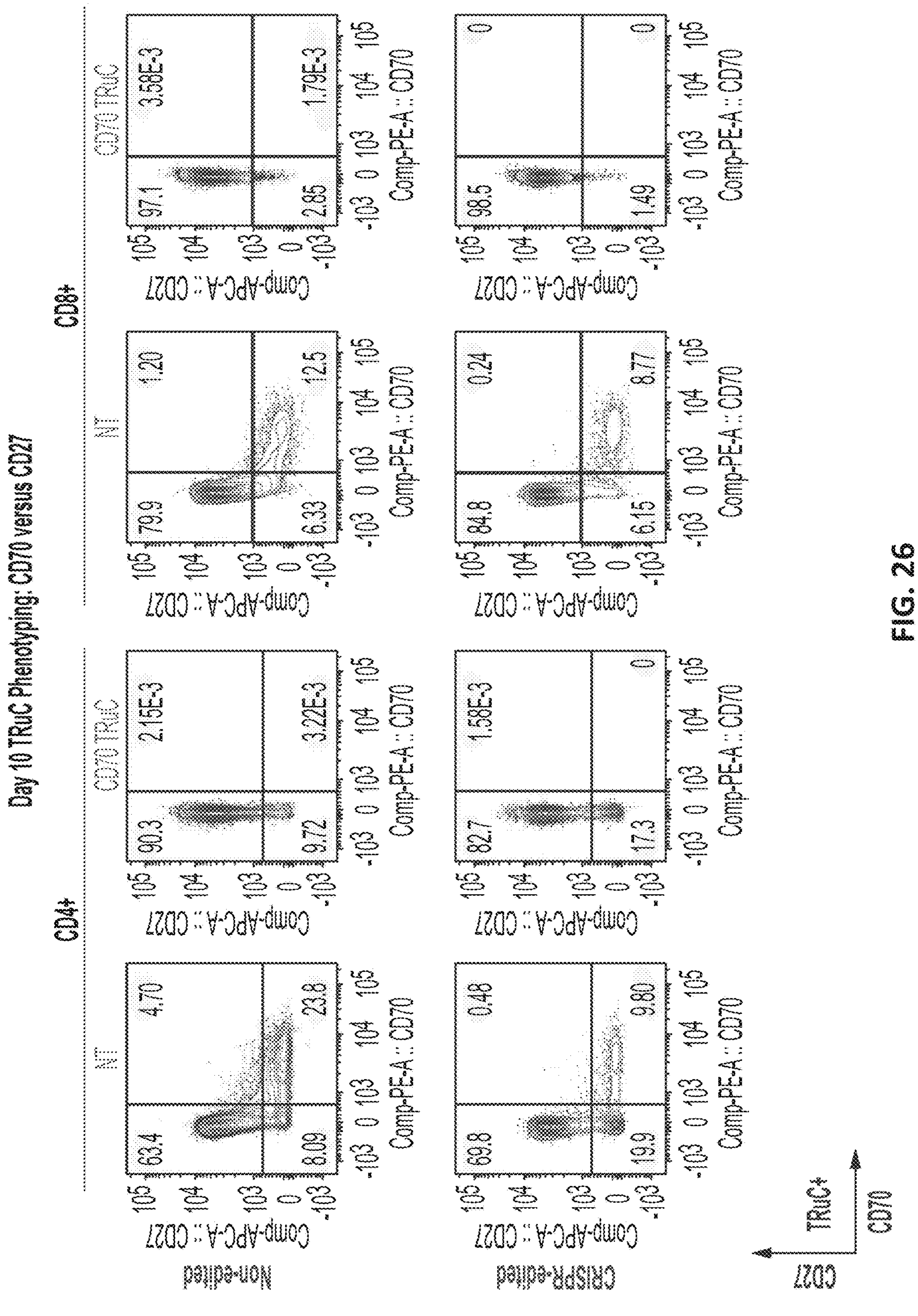
FIG. 26 is a series of plots illustrating the proportion of CD27+ and CD70+ T cells when TFP+ T cells are generated according to the methods described in Example 10 in non-edited and CD70 CRISPR edited cells.
Figures 27A, 27B:
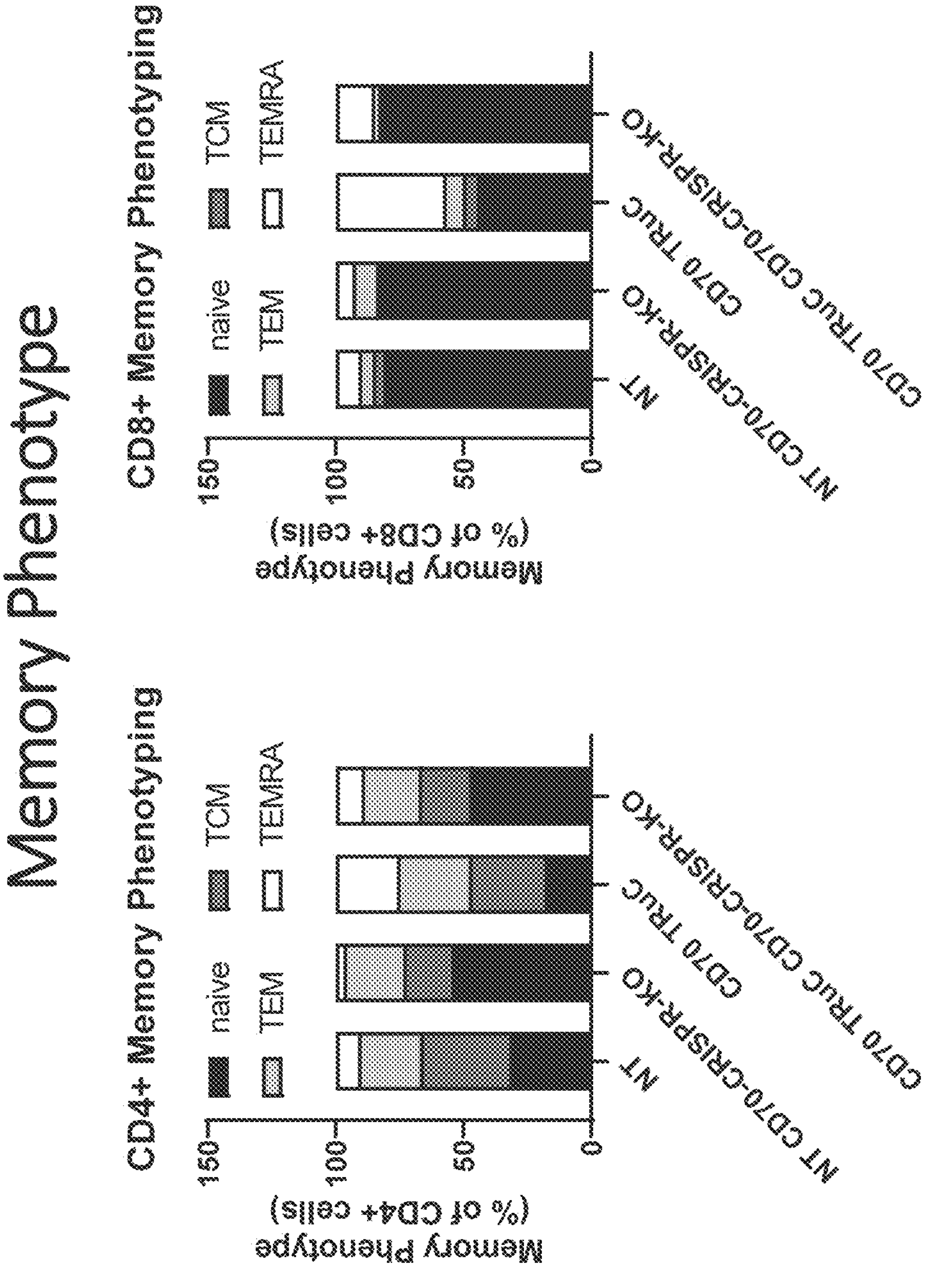
FIGS. 27A and 27B are a series of graphs illustrating the memory phenotype of T cells when TFP+ T cells are generated according to the methods described in Example 10 in non-edited and CD70 CRISPR edited cells.
Figure 28:
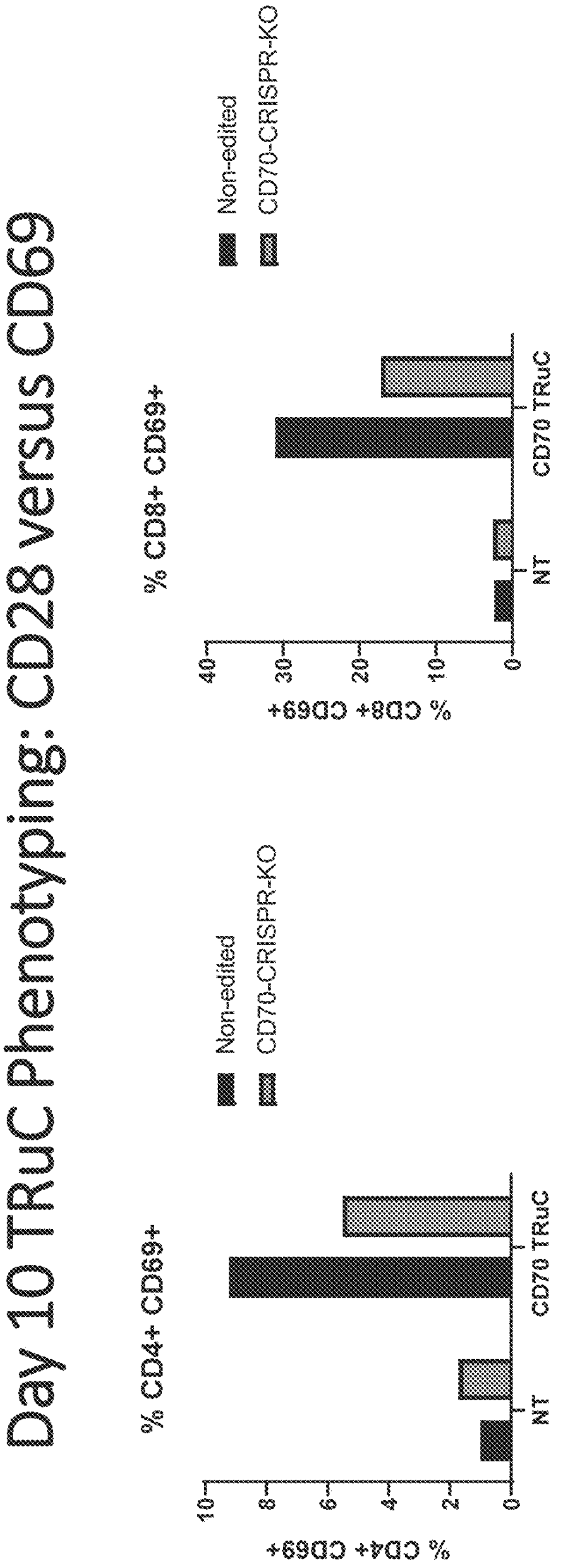
FIG. 28 provides a series of graphs showing the proportion of CCR69+ CD4+ and CD8+ T cells when TFP+ T cells are generated according to the methods described in Example 10 in non-edited and CD70 CRISPR edited cells.

Phenotyping of the TFP transduced T cells was performed as described above in Example 9. At day 10 of expansion, T cells were harvested and the cells were characterized by flow cytometry with antibodies having the following tags. The proportion of CD4+ to CD8+ T cells was determined by flow cytometry with APC-Cy7 (to detect CD4+) and PerCP-Cy5.5 (to detect CD8+) (FIG. 25). FIG. 26 show CD27 (APC) staining against CD70 (PE) in CD4+ and CD8+ T cells. The memory status of the T cells was determined by flow cytometry with BV786 (to detect CD45RA) and BV421 (to detect CCR7) in CD4+ T cells (FIG. 27A) and in CD8+ T cells (FIG. 27B). FIG. 28 show the proportion of CD69+(PECy7) CD4+ and CD8+ T cells.

As is shown in FIGS. 27A and 27B, CD4+ and CD8+ CD70.TFP T cells lacking CD70 have a higher level of naïve-like cells and decreased level TEMRA cells relative to cells having WT CD70. As is shown in FIG. 28, CD4+ CD70.TFP T cells and CD8+ CD70.TFP T cells lacking CD70 have reduced levels of CD69+ cells relative to cells having WT CD70. These results suggest that CD70 knockout promotes a naïve phenotype in TFP+ T cells.

Example 11: Antibody Blockin2 of CD70 TFP T Cells

Figure 29:
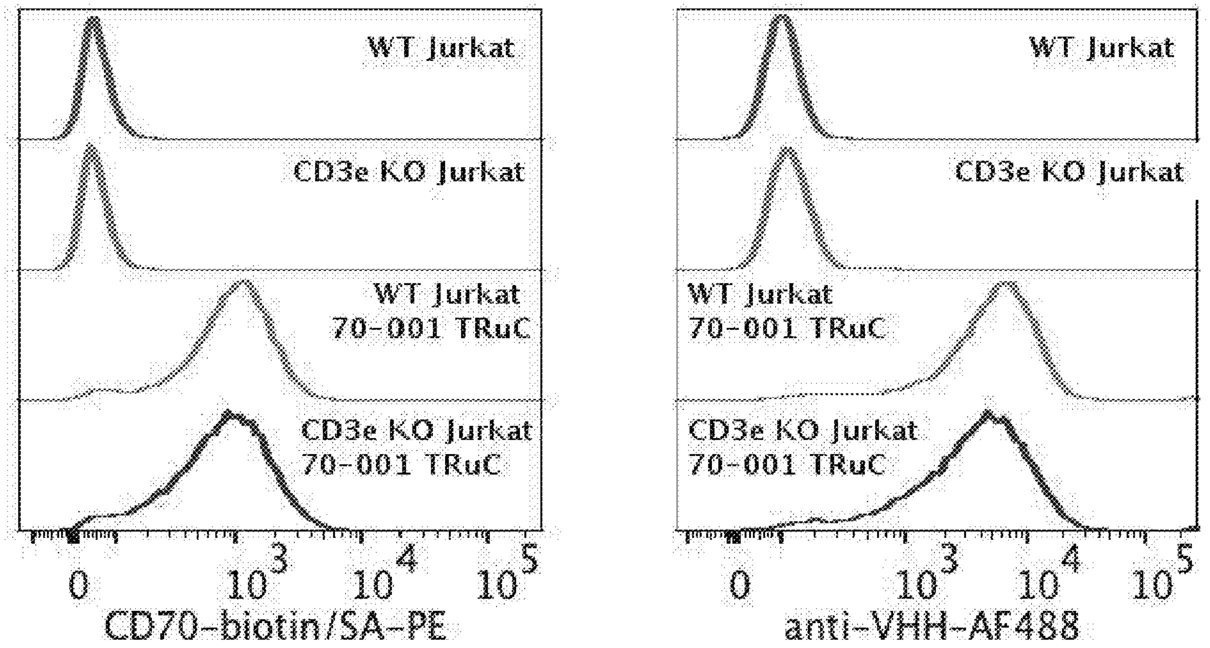
FIG. 29 is a series of graphs showing detection of 70-001 TFP expression in wild type and CD3ε knockout jurkat cells with CD70-biotin/SA-PE and anti-VHH-AF488 by flow cytometry. TRuCs generated using VIN70069 virus (IU titer 6.5E7)
Figure 30A:
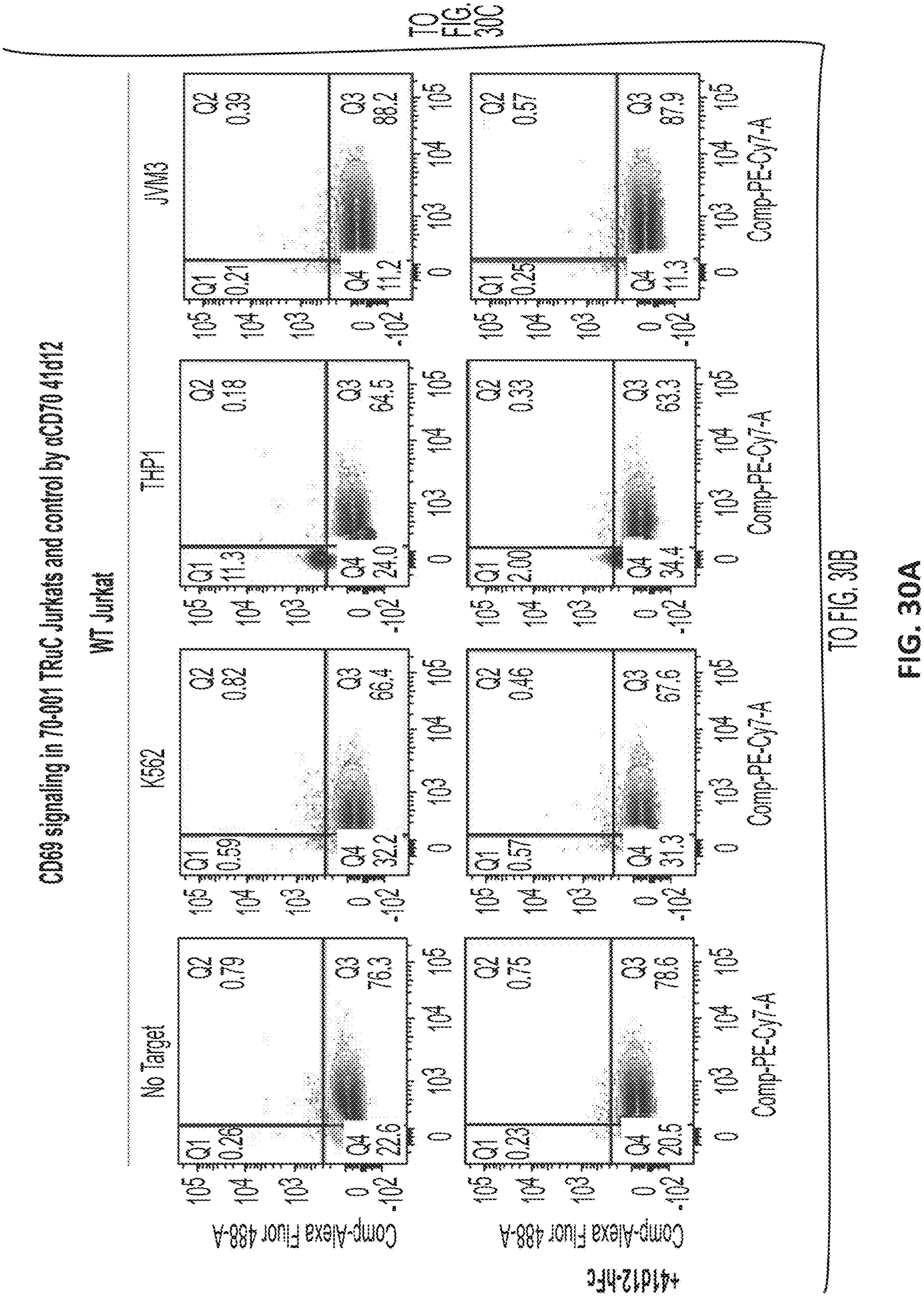
FIG. 30 is a series of plots illustrating the proportion of VHH+ and CD69+ jurkat cells (wild type or CD3ε knock out) transduced with the 70-001 TFP when co-cultured at a 1:1 ratio with CD70− negative K562 cells, CD70-positive THP-1 AML cells, CD70-positive JVM3 cells, or a no target cell control for 16 hours in the presence or absence of 5 μM41D12 anti-CD70 antibody.
Figure 30B:
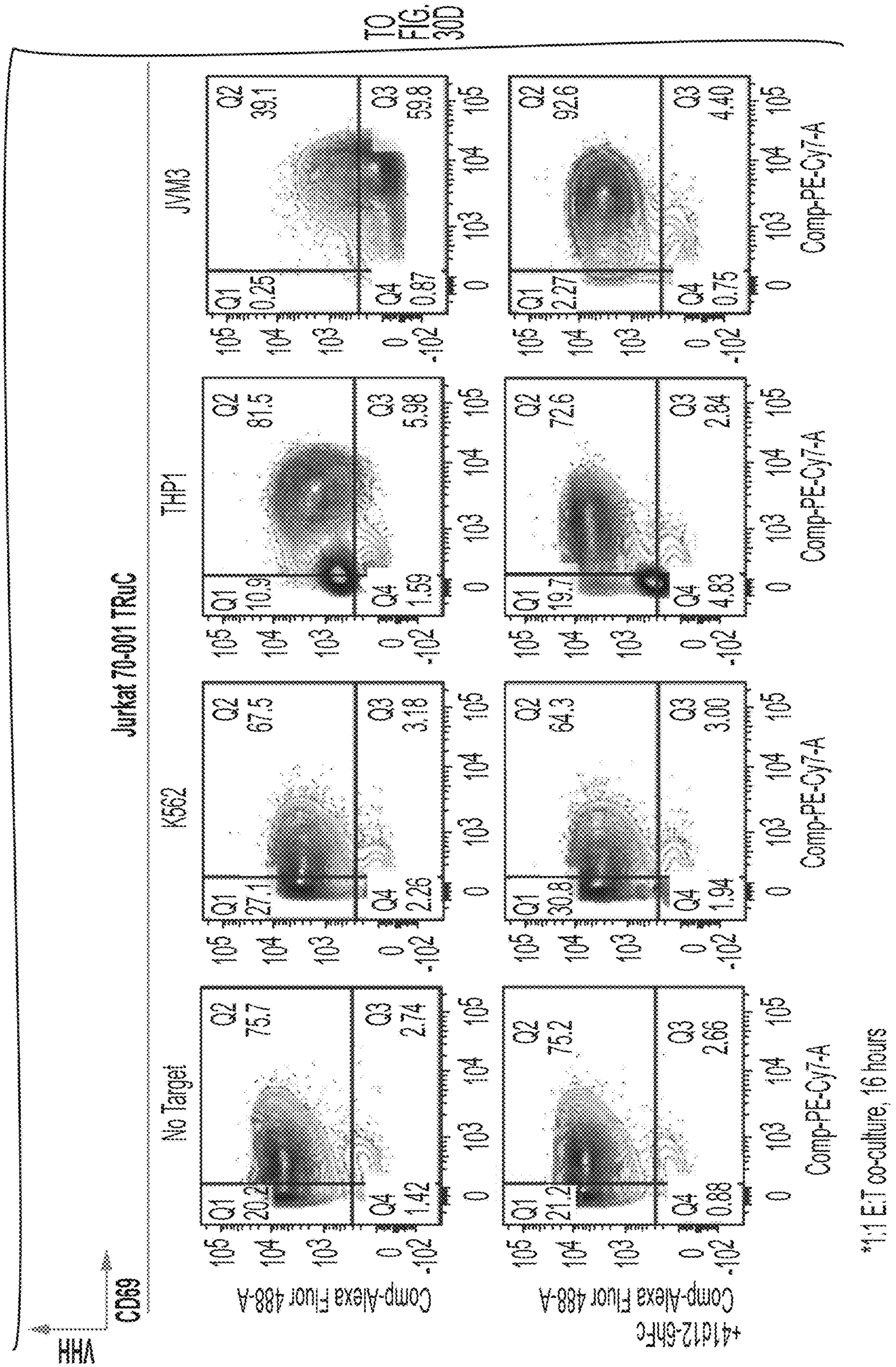
Figure 30C:
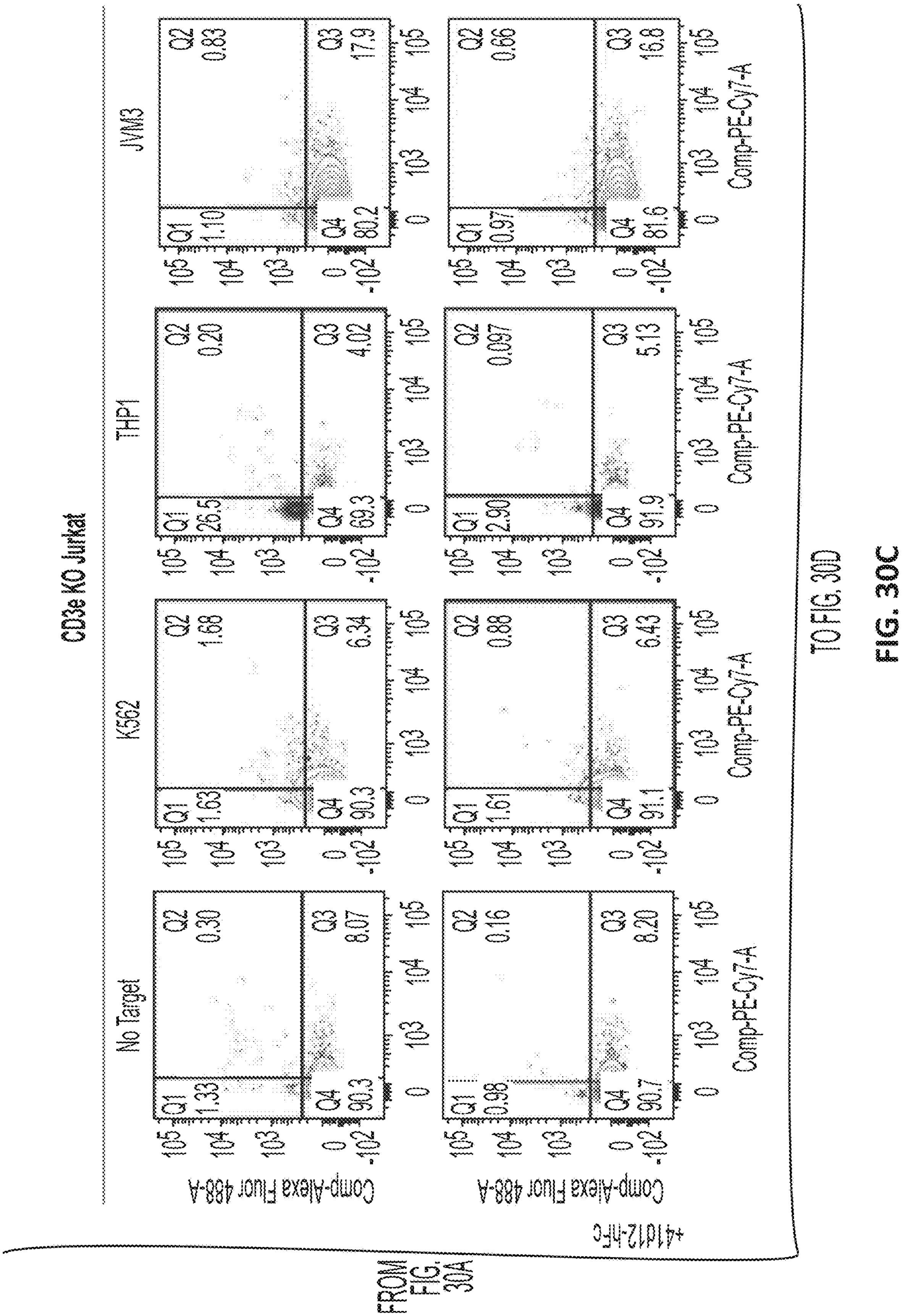
Figure 30D:
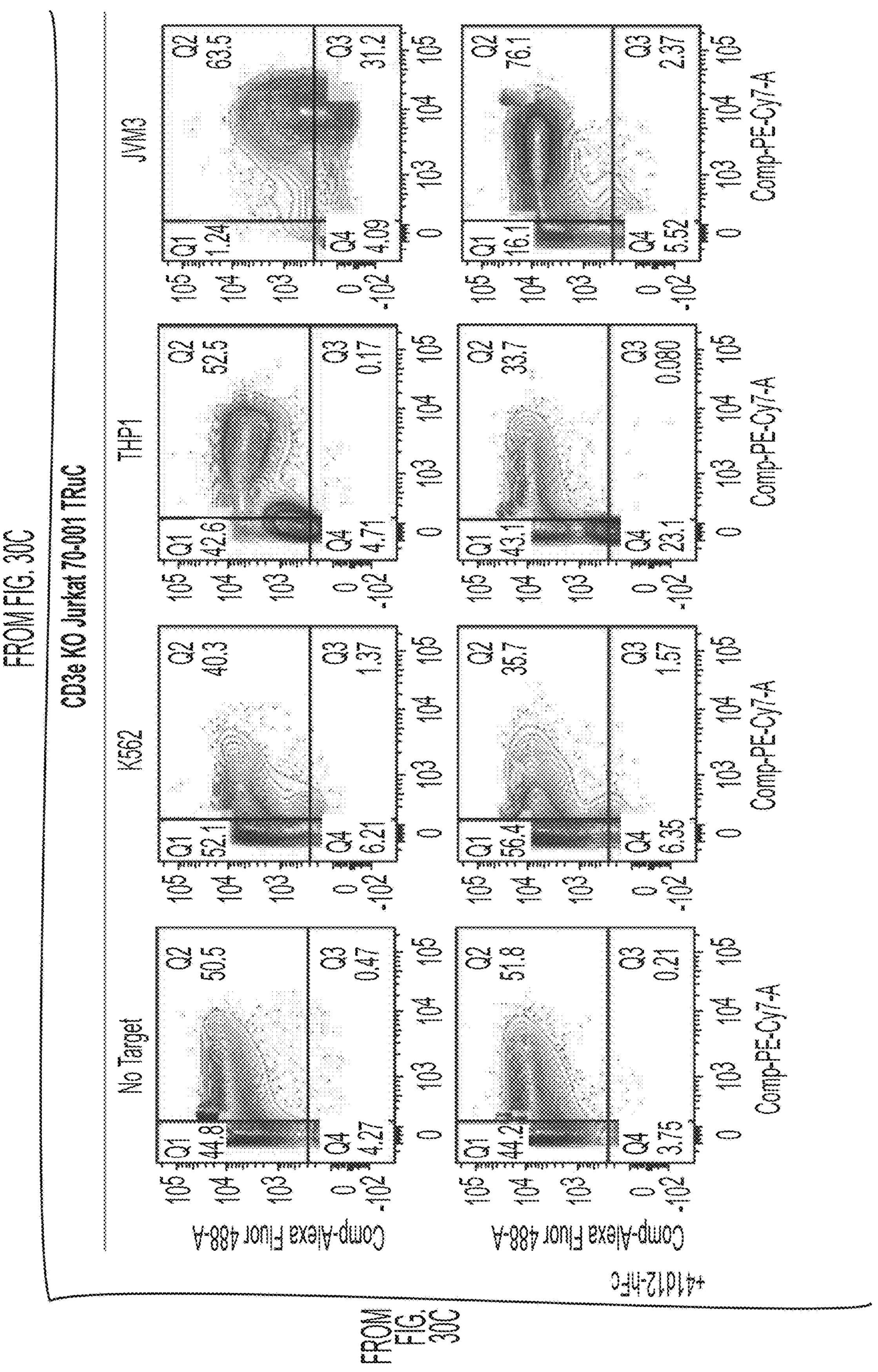
Figure 31:
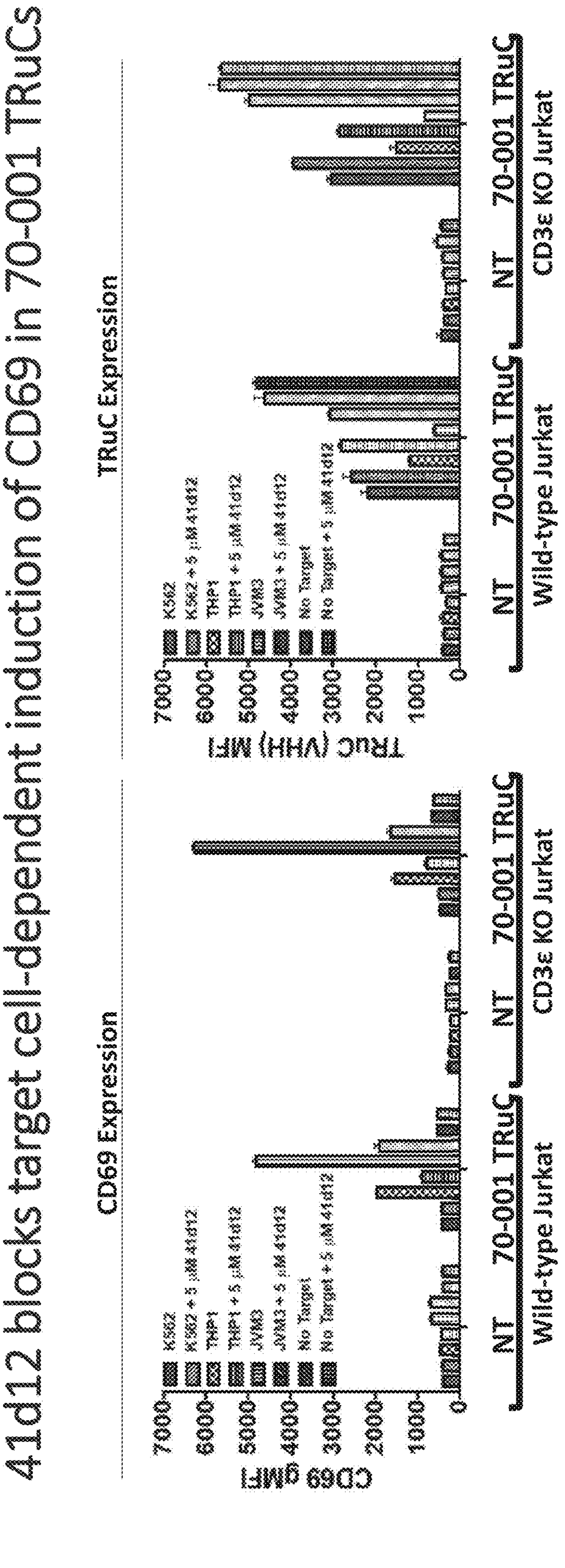
FIG. 31 is a graphical representation of the flow plot data shown in FIG. 30.
Figure 32A:
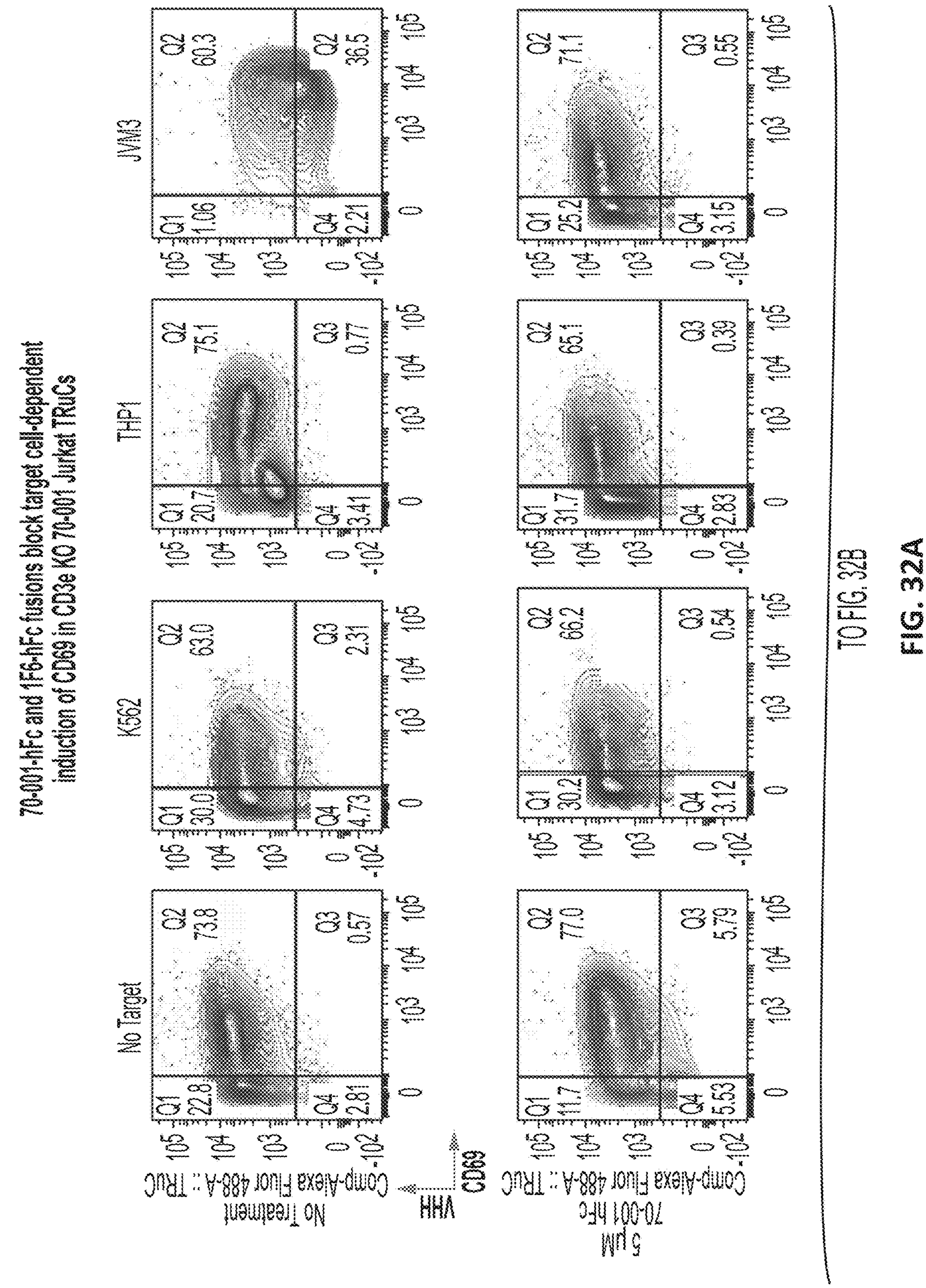
FIG. 32 is a series of plots illustrating the proportion of VHH+ and CD69+ CD3ε knock out jurkat cells transduced with the 70-001 TFP when co-cultured at a 1:1 ratio with CD70-negative K562 cells, CD70-positive THP-1 AML cells, CD70-positive JVM3 cells, or a no target cell control for 16 hours in the presence or absence of anti-CD70 antibodies (5 μM 1F6-hFc or 70-001-hFc or 10 μM 41D12).
Figure 32B:
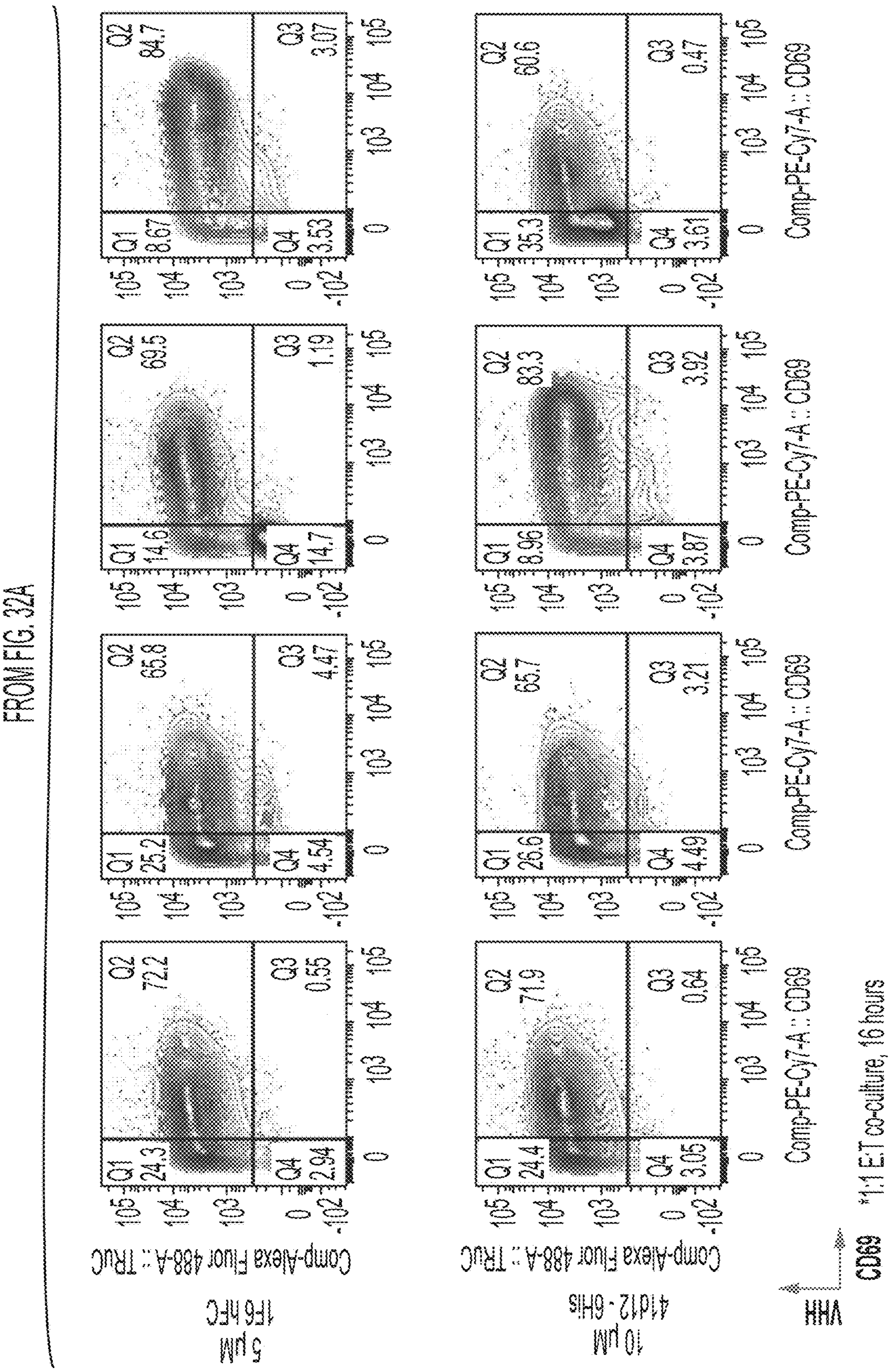
Figure 33:
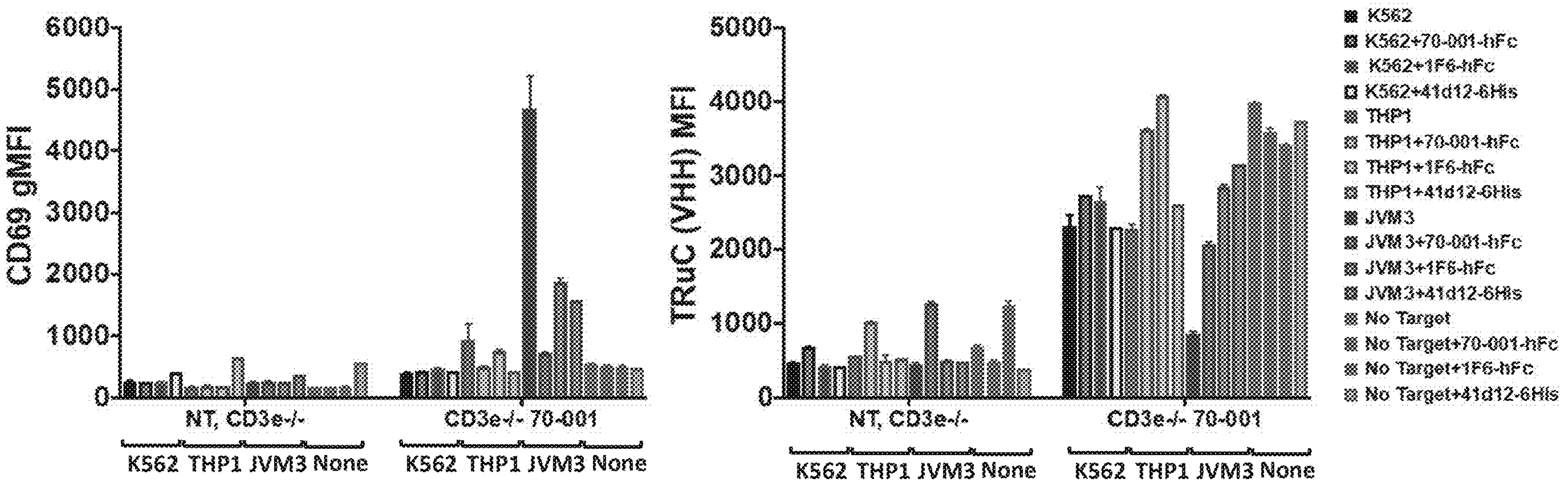
FIG. 33 is a graphical representation of the flow plot data shown in FIG. 32.

The ability of anti-CD70 antibody to block the activity of CD70 TFPs was assessed. The 70-001 (P3E8) TFP was expressed in WT or CD3ε knockout Jurkats. Expression of the CD70 TFP was assessed by flow cytometry. CD70 TFP expression was determined by staining with biotin tagged CD70 or anti-VHH antibody (FIG. 29). CD70 TFP-expressing cells were co-cultured with target expressing cells in the presence or absence of anti-CD70 antibody to assess the ability of anti-CD70 antibody to block activation of the TFP-expressing cells. CD70 TFP-expressing cells were co-cultured at a 1:1 ratio with CD70-negative K562 cells, CD70-positive THP-1 AML cells, or CD70-positive JVM3 cells for 16 hours in the presence or absence of 5 μM41D12 anti-CD70 antibody. TFP T cell activation was assessed by CD69 expression. Wild-type and CD3ε knock-out jurkat cells expressing the 70-001 (P3E8) TFP showed increased CD69 expression when contacted with CD70-expressing THP-1 or JVM3 cell lines, and this increase in T cell activation was reduced in the presence of anti-CD70 antibody (FIG. 30 and FIG. 31). The increase in CD69 expression observed in CD70 TFP expressing cells when contacted with CD70 expressing target cells was greater for JVM3 target cells than THP-1 target cells and this is consistent with JVM3 target cells having higher levels of CD70 expression than THP-1 cells. The experiment was repeated with three different anti-CD70 antibodies, co-culturing CD70 TFP-expressing CD3ε knock-out jurkat cells with CD70-negative K562 cells, CD70-positive THP-1 AML cells, and CD70-positive JVM3 cells at a 1:1 ratio for 16 hours in the presence or absence of 5 μM of anti-CD70 antibodies 1F6-hFc or 70-001-hFc or 10 μM 41D12. Similar results were observed with CD70 TFP-expressing CD3ε knock-out jurkat cells exhibiting increased CD69 expression upon co-culture with THP-1 or JVM3 target cells that was especially pronounced with JVM3 target cells. This increase was reduced by the addition of any of the three anti-CD70 antibodies to the co-culture (FIG. 32 and FIG. 33). These results suggest that anti-CD70 antibodies inhibit target-cell dependent induction of CD69 expression in Jurkat cells expressing CD70 TFPs mediated by engagement with CD70 on target cells and that the degree of antibody blockade of CD69 induction correlates positively with target cell CD70 expression.

Example 12: Generation of Human scFv Anti-CD70 Antibodies

Figure 34:
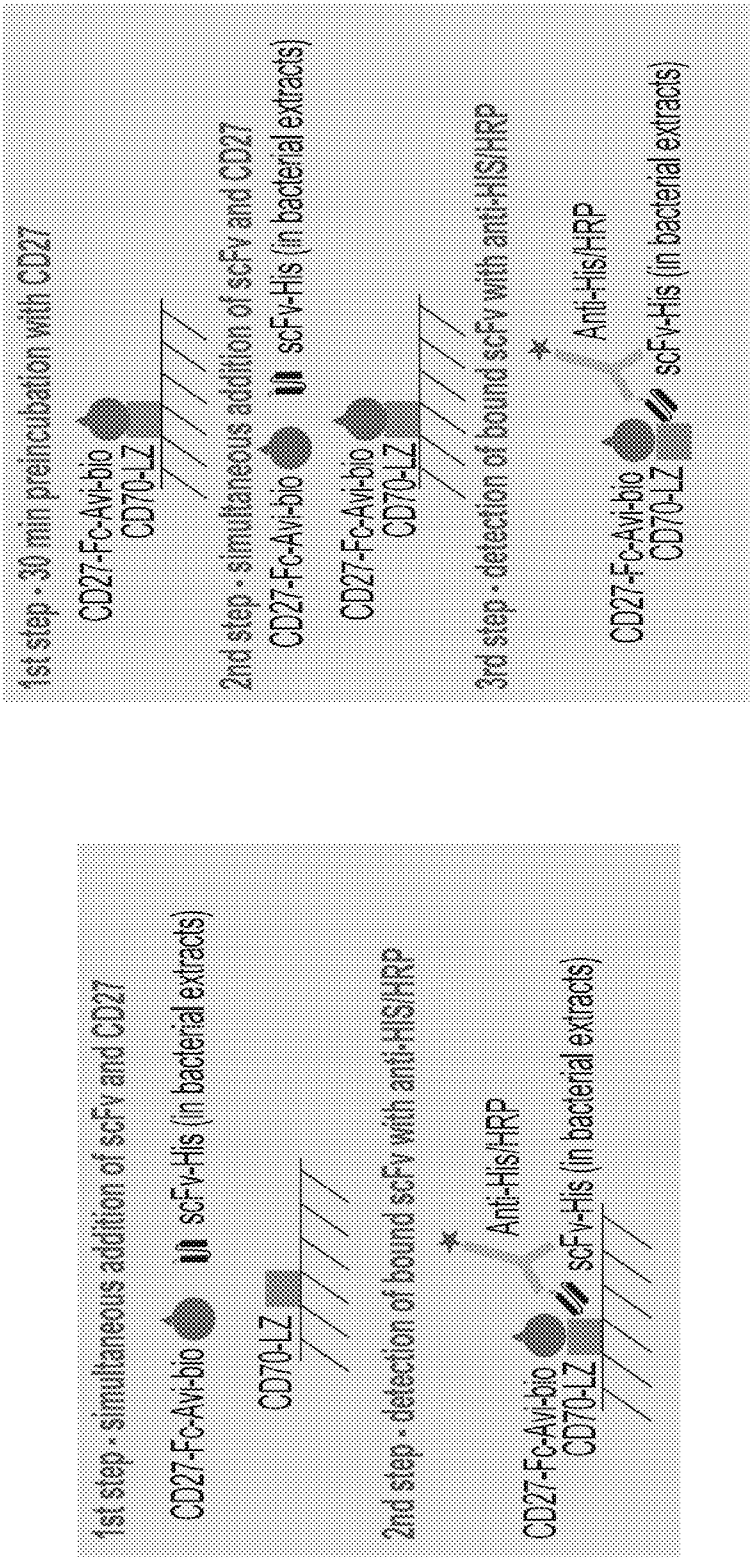
FIG. 34 is a schematic illustration of the ELISA assays used to measure the ability of CD27 to block CD70 binding was measured by ELISA described in Example 12.

Human scFv antibodies binding CD70 were generated by panning a naïve human library with the extracellular domain (aa39-193) of CD70. 53 antibodies were identified. The ability of CD27 to block CD70 binding of the identified antibodies was measured by ELISA using two different assays. In the first assay, CD27 and his-tagged scFv anti-CD70 binders were simultaneously added to surface bound CD70, and the ability of the scFv binders to bind CD70 was detected with anti-His HRP. In the second assay, plate-bound CD70 was pre-incubated with CD27 for 30 minutes, and then additional CD27 and the his-tagged scFv anti-CD70 binder was added. The ability of the scFv binders to bind CD70 was detected with anti-His HRP. FIG. 34 is a schematic of the two different CD27 blocking assays. CD70 affinity was also measured by SPR analysis. scFv antibodies were also tested for their ability to bind tumor cell lines with high (CHO-CD70, JVM3, and U266) and low levels (CHO WT and K562 of CD70 expression. Results for 39 antibodies are shown in Table 1 below.

TABLE 1

Characterization of human anti-CD70 scFv antibodies

| ID | Blocking Assay - 3 μM purified ScFv | | 1.25 μg/mL purified scFv | | | | | Affinity |
|---|---|---|---|---|---|---|---|---|
| | anti His/HRP | strep/HRP | CHO-CD70 | CHO-wt | JVM-3 | K562 | U266 | SPR KD [nM] |
| 30-TC1.2-I-C08-1 | 1.833 | 1.501 | 502876 | 952 | 37430 | 2133 | 17386 | 6.73E−08 |
| 14-TC4-III-A04 | 2.813 | 0.359 | 609971 | 934 | 16992 | 2001 | 20385 | 1.37E−08 |
| 14-TC6-I-F03 | 2.468 | 0.954 | 33422 | 926 | 1882 | 2156 | 1430 | 2.89E−07 |
| 15-TC7-I-D07 | 2.502 | 1.454 | 270863.5 | 1002 | 50870.5 | 2476 | 42930.5 | 1.75E−06 |
| 13-TC7-I-E11 | 2.286 | 1.418 | 531981 | 1025 | 80470 | 2254 | 32016 | 4.47E−08 |
| 1-TC4-I-C10 (C10 or 1867) | 2.83 | 0.075 | 977726.5 | 873 | 73251 | 2000 | 48756 | 6.17E−09 |

TABLE 1-continued

| Characterization of human anti-CD70 scFv antibodies | | | | | | | | |
|---|---|---|---|---|---|---|---|---|
| | Blocking Assay - 3 μM purified ScFv | | 1.25 μg/mL purified scFv | | | | | Affinity |
| ID | anti His/HRP | strep/HRP | CHO-CD70 | CHO-wt | JVM-3 | K562 | U266 | SPR KD [nM] |
| 16-TC4-I-C11 | 2.095 | 1.433 | 660352 | 969 | 103043 | 1974 | 51004 | 4.02E−08 |
| 4-TC4-I-G08 | 2.291 | 1.028 | 387163 | 945 | 33985 | 2114 | 23455 | 1.41E−06 |
| 32-TC1.2-I-F07-6 (F07-6) | 2.423 | 0.113 | 553390 | 886 | 57255.5 | 2129 | 20740 | 7.41E−09 |
| 39-TC6-IV-B08 (B08 or 1885) | 2.973 | 0.268 | 52166.5 | 829 | 25288 | 1946 | 35857 | 2.89E−06 |
| 41-TC7-VII-A06 | 1.145 | 1.522 | 8936 | 821 | 1225 | 1835 | 1827 | 4.02E−06 |
| 37-TC7-VII-D05 | 2.279 | 0.655 | 111442 | 958 | 10983 | 1868 | 15862 | 5.64E−06 |
| 13-TC7-V-H10 | 1.97 | 1.378 | 601015.5 | 1116 | 87466 | 2018 | 34269 | 6.69E−08 |
| 60-TC7-VII-C02 (C02) | 1.269 | 1.576 | 457505 | 930 | 10796 | 1938 | 5038 | 1.35E−07 |
| 53-TC7-VI-B06 | 1.382 | 1.439 | 12209 | 1062 | 1829 | 2397 | 1170 | 2.35E−07 |
| 50-TC7-III-A11 (A11 or 1985) | 2.251 | 0.868 | 121682 | 799 | 12209 | 2099 | 44995 | 4.19E−06 |
| 47-TC7-III-D10 | 1.501 | 1.552 | 312525 | 878 | 34664 | 2130 | 18982 | 1.86E−08 |
| 62-TC7-V-D08 | 2.001 | 1.539 | 286252 | 909 | 45189 | 2346 | 35255 | 1.94E−07 |
| 57-TC7-VII-A03 (A03) | 1.894 | 1.494 | 163394.5 | 1393 | 1642 | 4037 | 3150 | 8.53E−07 |
| 61-TC7-IV-H08 (H08) | 0.711 | 1.525 | 64912 | 1684 | 1071 | 3331 | 947 | 3.32E−07 |
| 54-TC7-V-D10 | 1.464 | 1.172 | 240320.5 | 1929 | 2130 | 3082 | 1144 | 2.09E−07 |
| 38-TC7-V-G06 | 1.02 | 1.535 | 1344776.5 | 1344 | 27391 | 2852 | 16935.5 | 1.82E−07 |
| 44-TC7-V-H07 | 1.661 | 1.49 | 511597 | 1222 | 1593 | 2641 | 1819 | 8.20E−06 |
| 22-TC7-VI-C03 | 1.915 | 1.459 | 246764 | 1811 | 5023 | 2493 | 2529 | 1.44E−06 |
| 56-TC7-VI-H08 | 1.505 | 1.44 | 295958 | 1651 | 2364 | 3031 | 6307 | 5.35E−07 |
| 40-TC7-VI-F11 | 1.843 | 1.369 | 234690 | 1922 | 4873 | 3319 | 11820 | 2.79E−07 |
| 46-TC7-VII-E11 | 2.278 | 1.265 | 76242 | 1671 | 1786 | 3258 | 2286 | 1.80E−07 |
| 51-TC7-VIII-G06 | 0.676 | 1.461 | 169887.5 | 1077 | 4255 | 2861 | 2143 | 5.32E−07 |
| 52-TC7-VIII-C02 | 1.563 | 0.533 | 430036 | 1059 | 8049 | 3059 | 2984 | 6.46E−08 |
| 55-TC4-IX-G04 | 1.243 | 1.282 | 87195 | 2236 | 3573 | 2591 | 2700 | 9.84E−07 |
| 42-TC4-VII-G08 | 2.341 | 1.106 | 364029 | 1686 | 33930 | 3188 | 13096 | 1.79E−07 |
| 35-TC6-VII-A09 | 0.639 | 1.485 | 1146331 | 1420 | 18809.5 | 3183 | 16508.5 | 3.67E−07 |
| 43-TC4-VII-C04 | 1.812 | 1.442 | 722932 | 1048 | 44998.5 | 3327 | 20038 | 6.99E−08 |
| 59-TC4-VII-F02 | 2.06 | 1.425 | 850162 | 1044 | 52141 | 3137 | 18505 | 1.01E−07 |
| 14-TC4-XIII-A01 | 1.739 | 1.463 | 111185.5 | 1829 | 1293 | 2973 | 953 | 2.83E−06 |
| 58-TC7-III-G11 | 1.974 | 0.503 | 276691.5 | 1931 | 14697 | 2224 | 12018 | 8.90E−06 |
| 49-TC4-XVI-F01 | 2.116 | 1.29 | 133959 | 1925 | 5407 | 3103 | 2978 | 1.06E−06 |
| 45-TC7-V-G04 | 2.153 | 0.926 | 416410 | 1450 | 41459.5 | 2478 | 19718.5 | 7.87E−08 |
| 36-TC6-VI-D04 | 1.533 | 1.513 | 977106 | 1393 | 11637.5 | 2794 | 21256 | 1.19E−07 |

Figure 35:
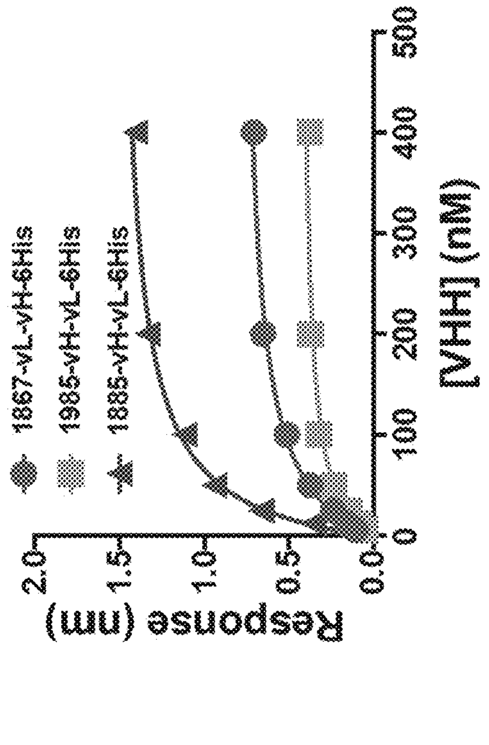
FIG. 35 is a graph showing octet titration to measure affinity of anti-CD70 scFv antibodies 1885 (B08), 1985 (A11), and 1867 (C10) for CD70. A group of scFvs were discovered by panning a naïve fully human scFv library, and a subset of these have been converted to TRuCs and are characterized here.

Octet titration was performed to more fully characterize the affinity of three of the anti-CD70 scFv antibodies, 1885 (B08 above), 1985 (A11 above), and 1867 (C10 above), for CD70 (FIG. 35). Biotinylated CD70 was immobilized on SA biosensors and titrated with the indicated 6His-tagged scFv. The data show well-fitted data for n=1 for 1885 and 1985 binders and n=2 for 1867 binders. The data is of high quality and shows that the scFvs bind CD70 with affinity ranging from 40-about 55 nM.

Example 13: Characterization of scFv and VHH Anti-CD70 Antibodies

Figure 36:
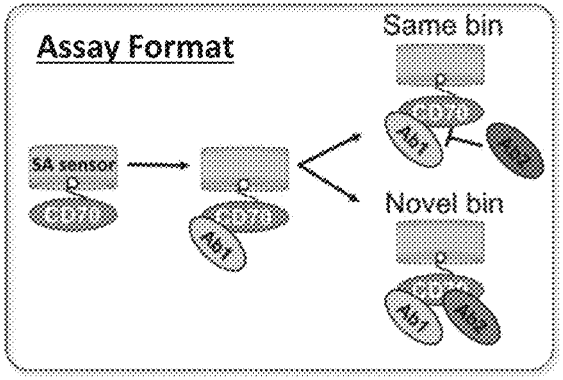
FIG. 36 shows the results of epitope binning assay for determining the binning of each of the anti-CD70 VHHs and scFvs shown and for CD27.
Figure 36:
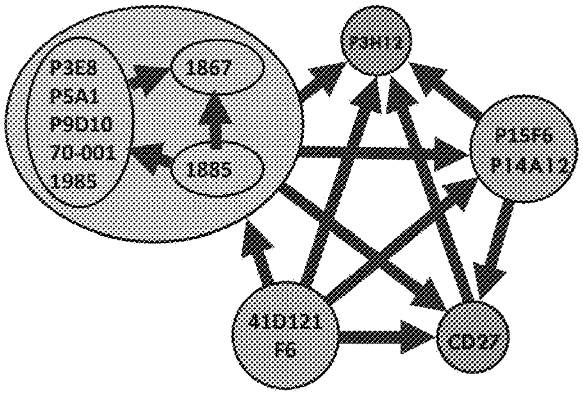

Epitope binning analysis was performed on the scFv and VHH antibodies identified. This was accomplished by immobilizing CD70 biotin on SA biosensors, pre-loading CD70 with a given antibody, and then challenging the antibody-bound CD70 with a second antibody to detect binding. A schematic of the assay is shown (FIG. 36). To understand the binning profile of the CD70 scFvs 1885 (B08 above), 1985 (A11 above), and 1867 (C10 above), they were binned against the VHH antibodies with unique binning behavior. While all of the VHHs tested map to the same general epitope region of CD70, in binning experiments they can be subgrouped based on how effectively they compete against one another, which can reflect subtle differences in binding. For that reason, the 70-001 and P3H12 VHHs, as well as 41d12 and the CD70 receptor, CD27 were used. The binning matrix shown demonstrates that antibody pairs marked in red boxes block one another, and that antibody pairs either block or displace one another in a pairwise fashion and those boxes are shown in yellow (FIG. 36). The antibodies all belong to the same larger binning group, but scFv 1985 (A11) can be categorized as most similar to 70-001 VHH, 1867 (C10) is in a bin that can be displaced by 70-001 VHH and 1885 (B08), and the 1885 is similar to 70-001,1985, and 1867, but potently outcompetes the other binders in this sub-bin. These data show that all CD70 binders, including 70-001, fit into 2 bins and both are boxed in bold in the binning matrix shown. Note yellow is unidirectional displacement, dark red is blocking, light red is self-blocking, and green in binding. We show here that all binders bin with all other binders, but that they can be subdivided into 2 bins based on CD27 blocking because while most binders block CD27 binding to CD70, VHH R3P3H12 does not. These binning behaviors appear to be due to structural factors, and/or binding kinetics, not merely affinity. The community plot at left groups affinity related binders into single nodes and shared bins are connected by arrows. The direction of arrow indicates that direction of displacement from CD70 (FIG. 36).

Figure 37A:
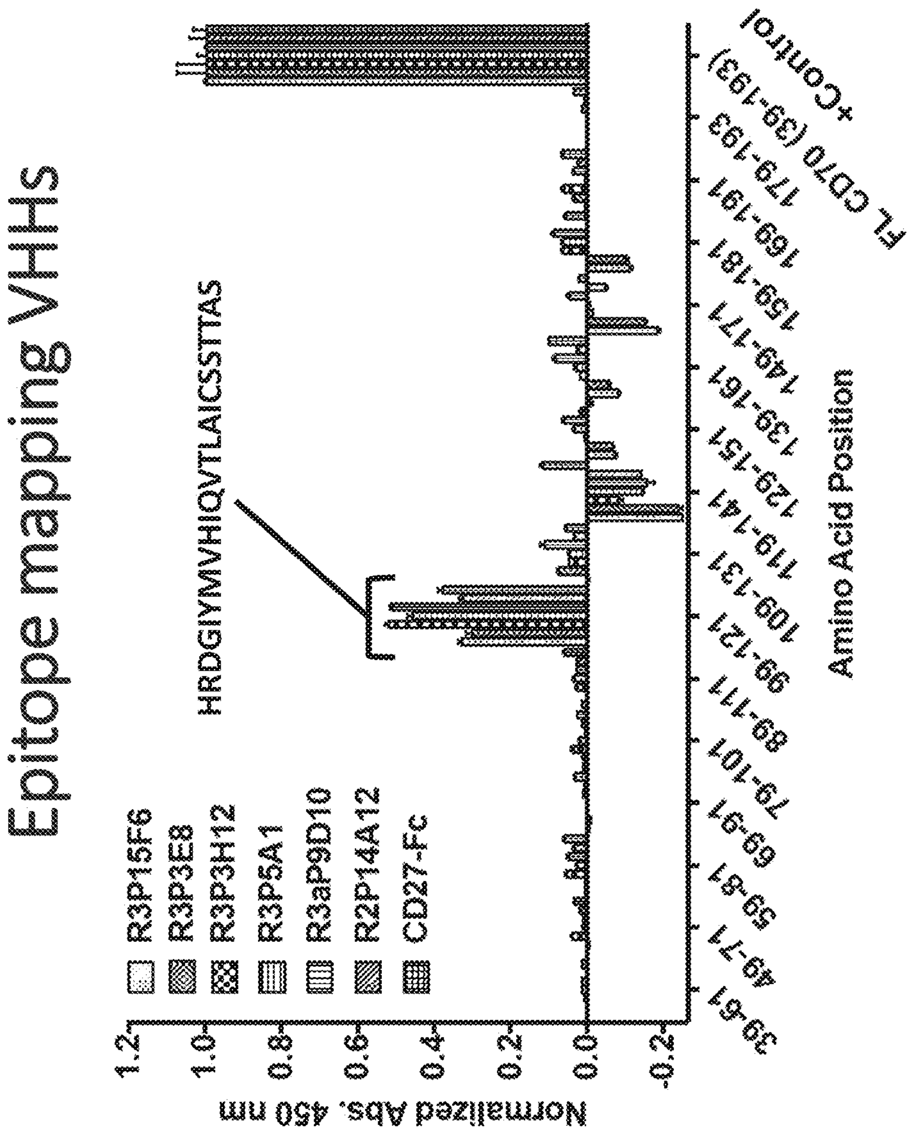
Figure 37B:
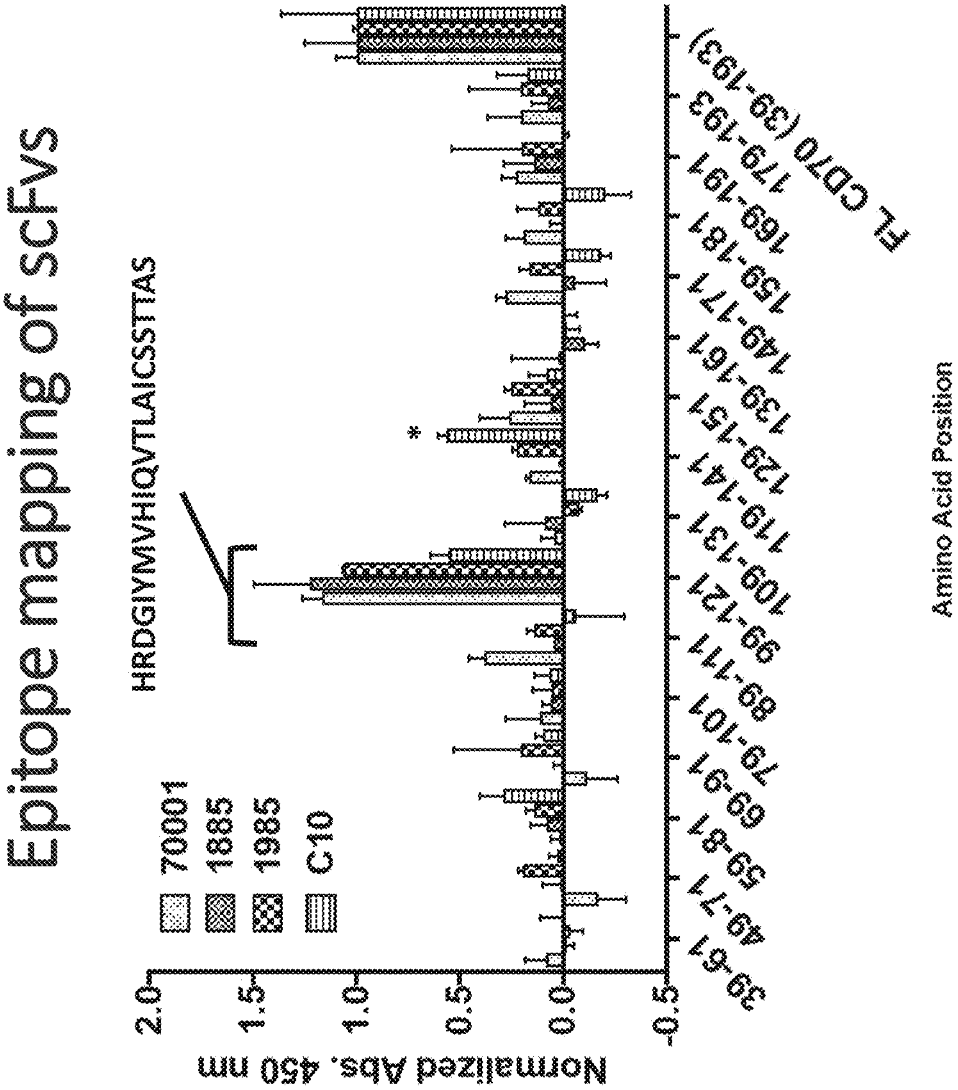

Epitope mapping was then done for a subset of the VHH and scFv anti-CD70 antibodies by testing binding of the antibodies to peptides having the amino acid sequence of the positions of CD70 indicated. All antibodies tested were found to bind the HIQVTLAICSS epitope FIG. 37). The C10 binder also bound a second epitope ASRHHPTTLAVG-ICSPASRSISL (SEQ ID NO: 1231).

Example 14: scFv TFP Constructs

Human scFv anti-CD70 TFP constructs were engineered by cloning the CD70 scFv DNA fragment linked to a CD3 or TCR DNA fragment by either a DNA sequence encoding a short linker (SL): AAAGGGGSGGGGSGGGGSLE (SEQ ID NO:692) or a long linker (LL): AAAIEVMYPP-PYLGGGGSGGGGSGGGGSLE (SEQ ID NO:693) into a lentiviral vector. Various other vector may be used to generate fusion protein constructs. TCR subunits that can be used are described in Example 3 above. Examples of the anti-CD70 TFP constructs generated include anti-CD70-linker-human CD3ε chain (including extracellular, transmembrane, and intracellular domains), with the anti-CD70 antigen binding domain being any of the scFv CD70 binding domains below:

TABLE 2

| Anti-CD70 binding domains | |
|---|---|
| TC4-I-C10 vLvH (C10 vLvH) | #1 |
| TC7-VI-H08 vLvH (H08 vLvH) | #2 |
| TC7-VII-A03 vLvH (A03 vLvH) | #3 |
| TC7-III-A11 vLvH (A11 vLvH) | #4 |
| TC6-IV-B08 vLvH (B08 vLvH) | #5 |
| TC4-1-C10 vHvL (C10 vHvL) | #6 |
| TC7-VI-H08 vHvL (H08 vHvL) | #7 |
| TC7-VII-A03 vHvL (A03 vHvL) | #8 |
| TC7-III-A11 vHvL (A11 vHvL) | #9 |
| TC6-IV-B08 vHvL (B08 vHvL) | #10 |

Example 15: Generation and Characterization of T Cell Receptor Fusion Protein Jurkat Cells Jurkat Cell Activation, Transduction, and Expansion CD3 epsilon knock-out Jurkat cells were generated by knocking out CD3ε subunit from wild-type (WT) Jurkat cells with CRISPR technique, as described, e.g., in co-pending U.S. Patent Publication No. 2017-0166622 and transduced with CD3ε TFPs having binders 1-10 shown in Table 2 above and cells were expanded.

Figure 38:
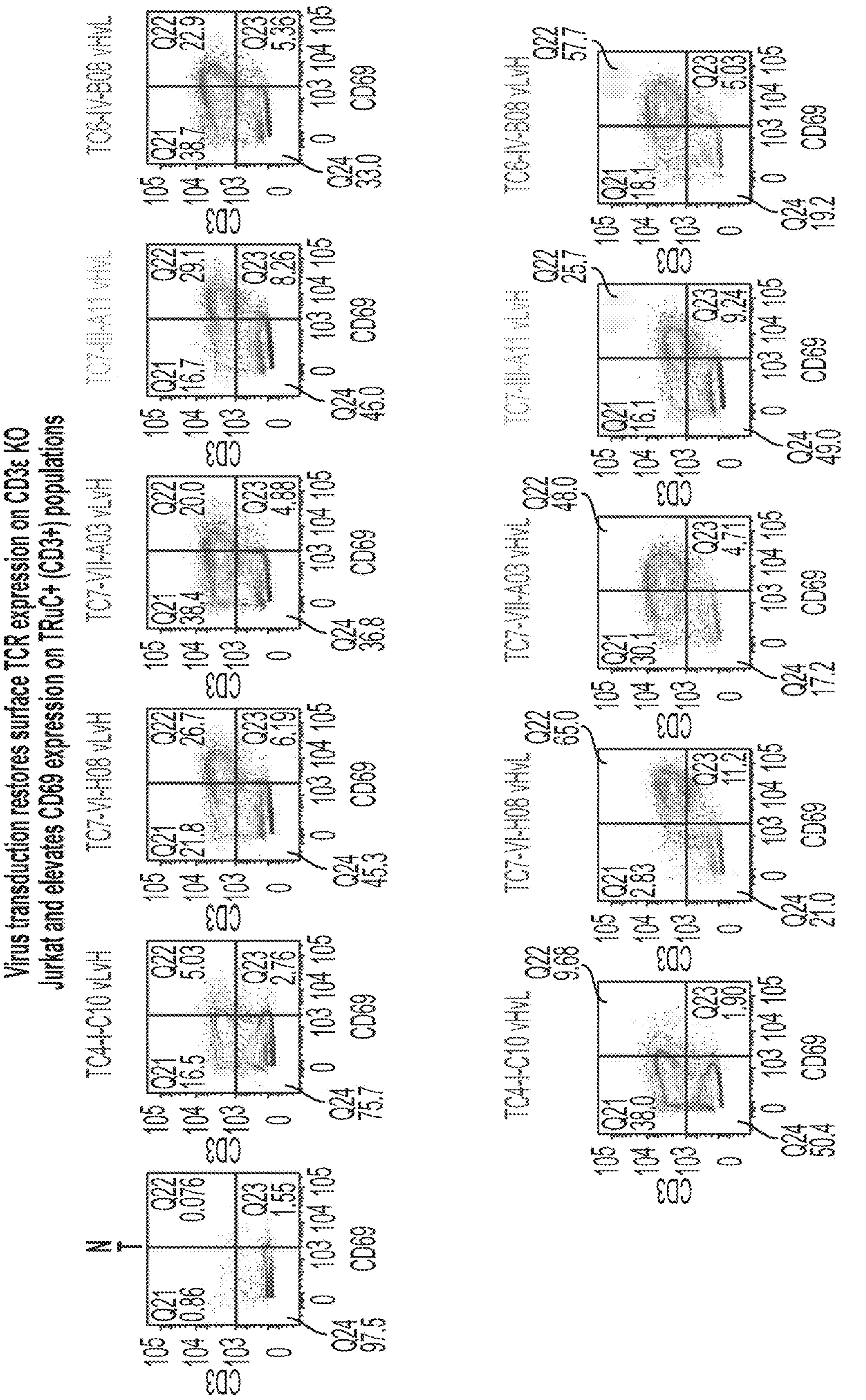
FIG. 38 is a series of plots showing flow cytometry data detecting CD69 expression and transduction efficiency as determined by CD3 expression in CD3ε knockout jurkat cells transduced with TFPs having the scFv binders shown or untransduced control T cells.
Figures 1, 39A:
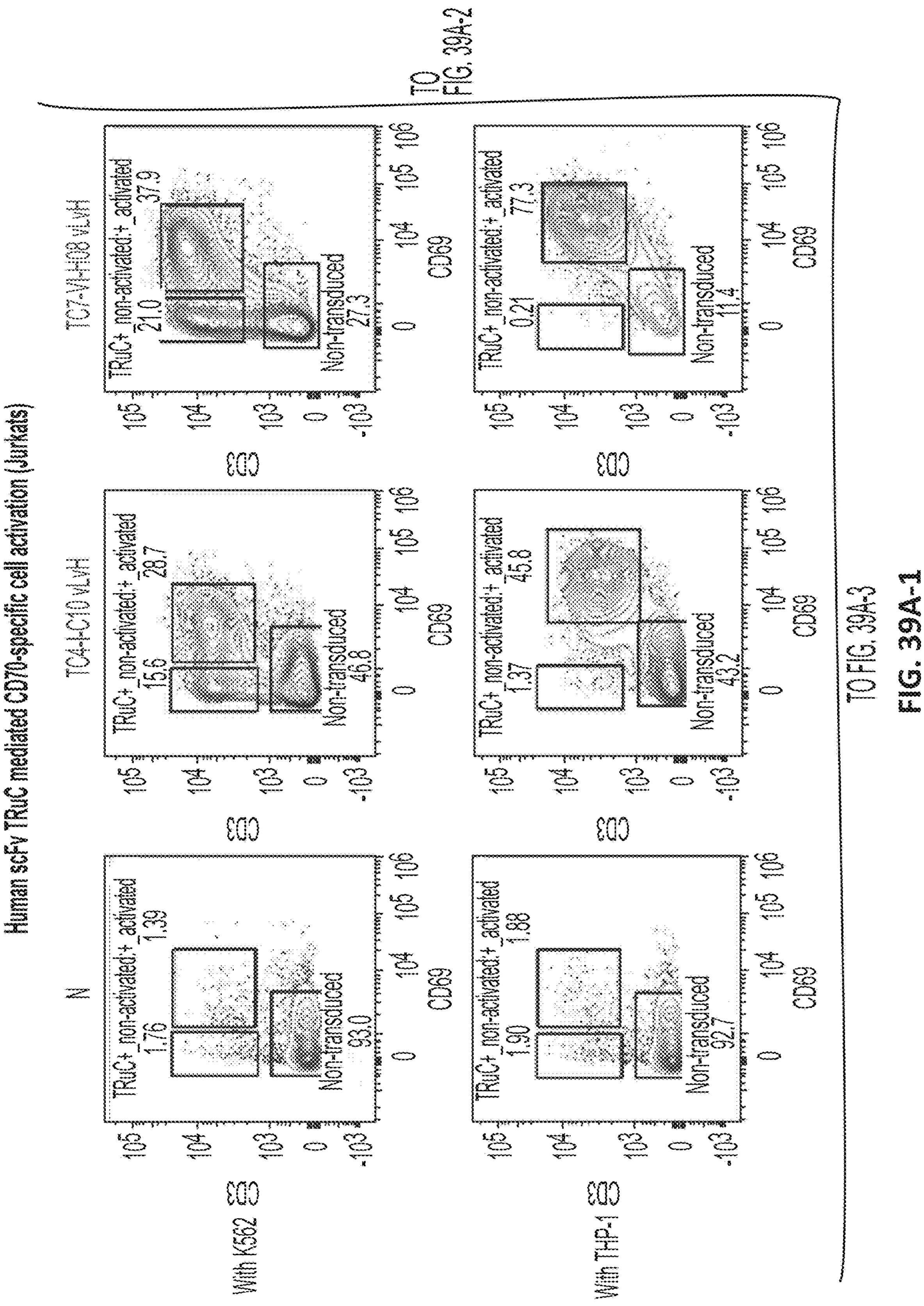
FIGS. 39A and 39B are a series of plots showing flow cytometry data detecting CD3 expression and CD69 expression in CD3ε knockout jurkat cells transduced with TFPs having the scFv binders shown after co-culture with K562, THP-1, ACHN cells, or 786-O target cells at a 1:1 ratio for 24 hours.
Figures 2, 39A:
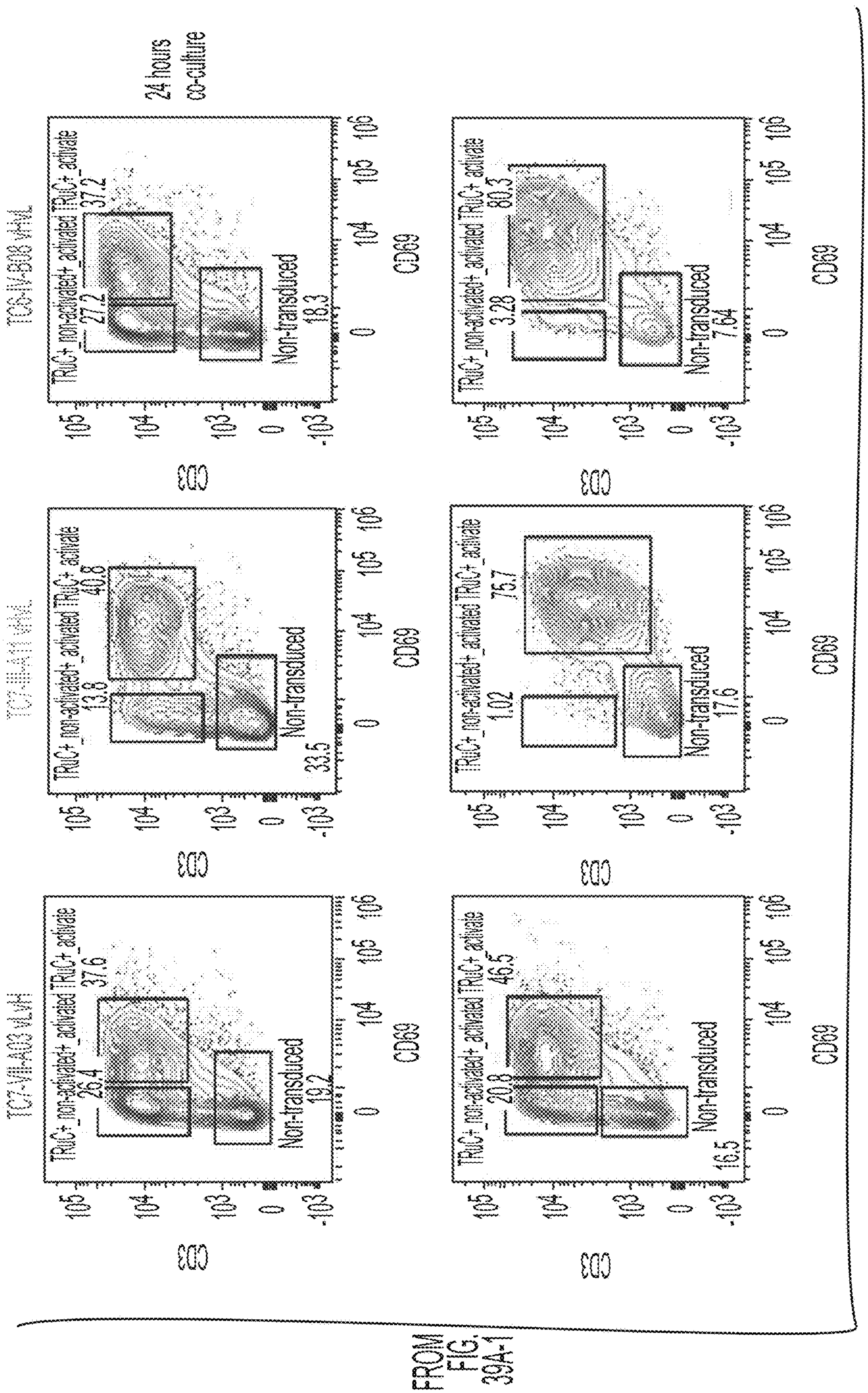
Figures 3, 39A:
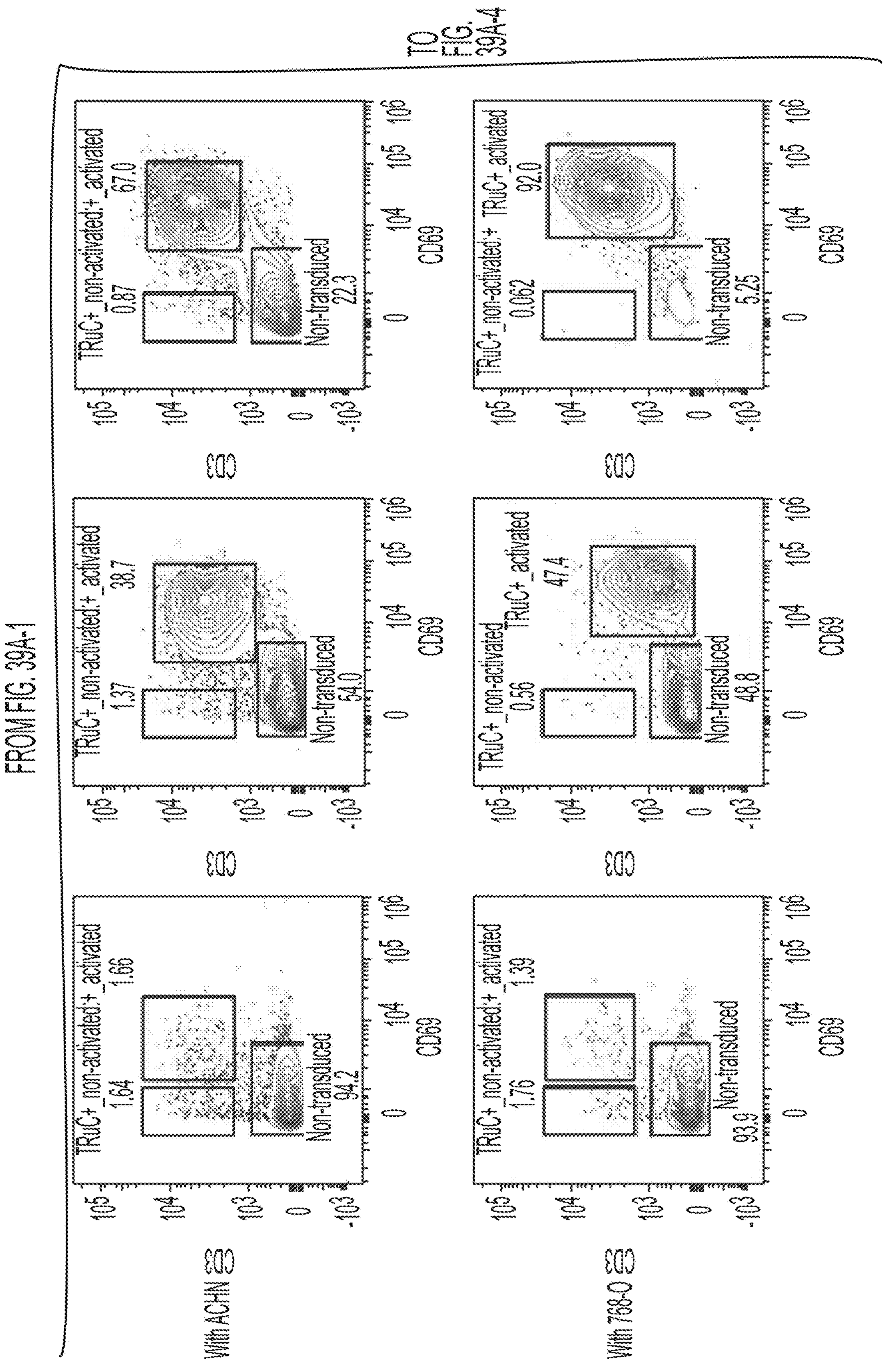
Figures 4, 39A:
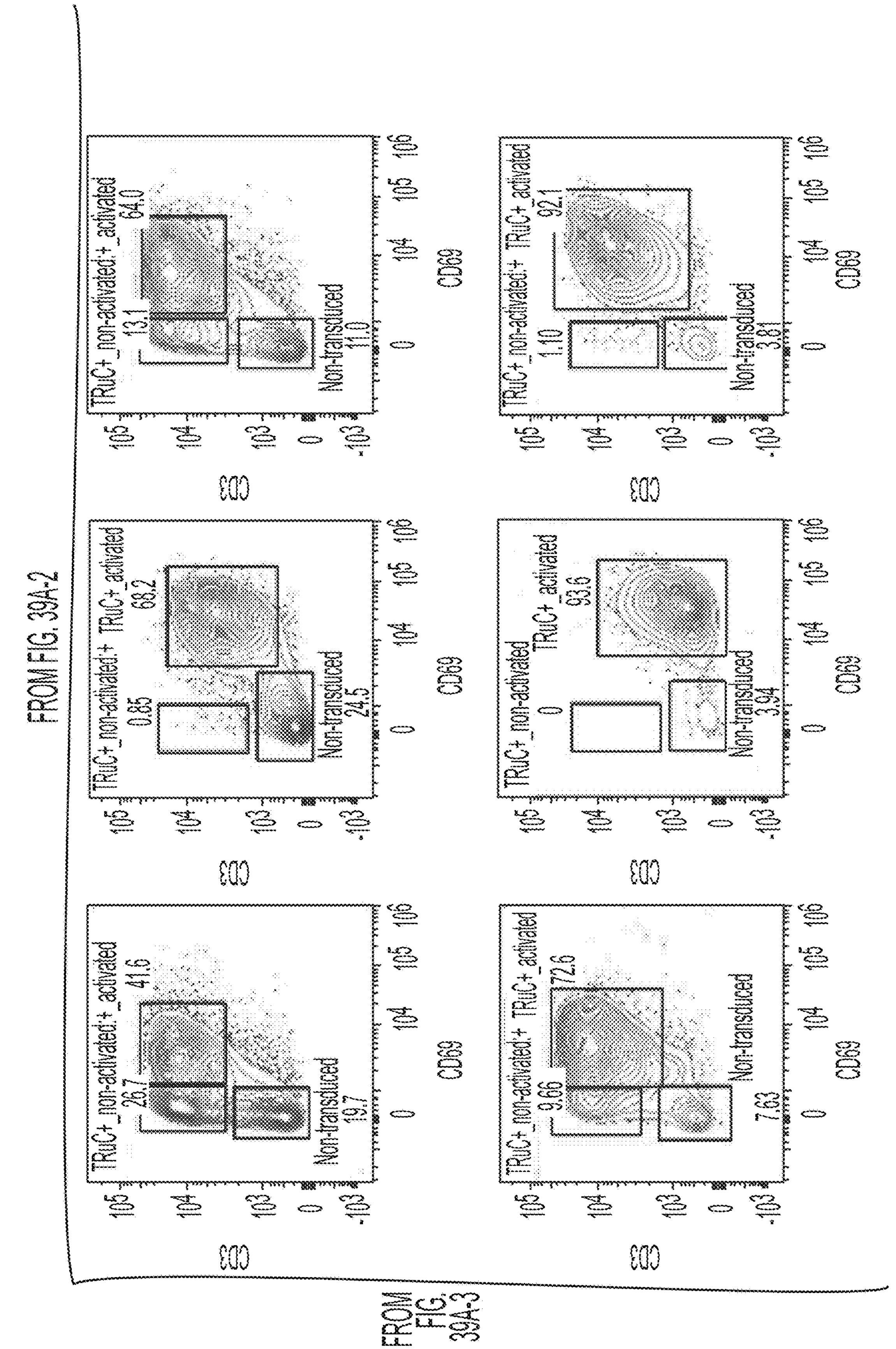
Figures 1, 39B:
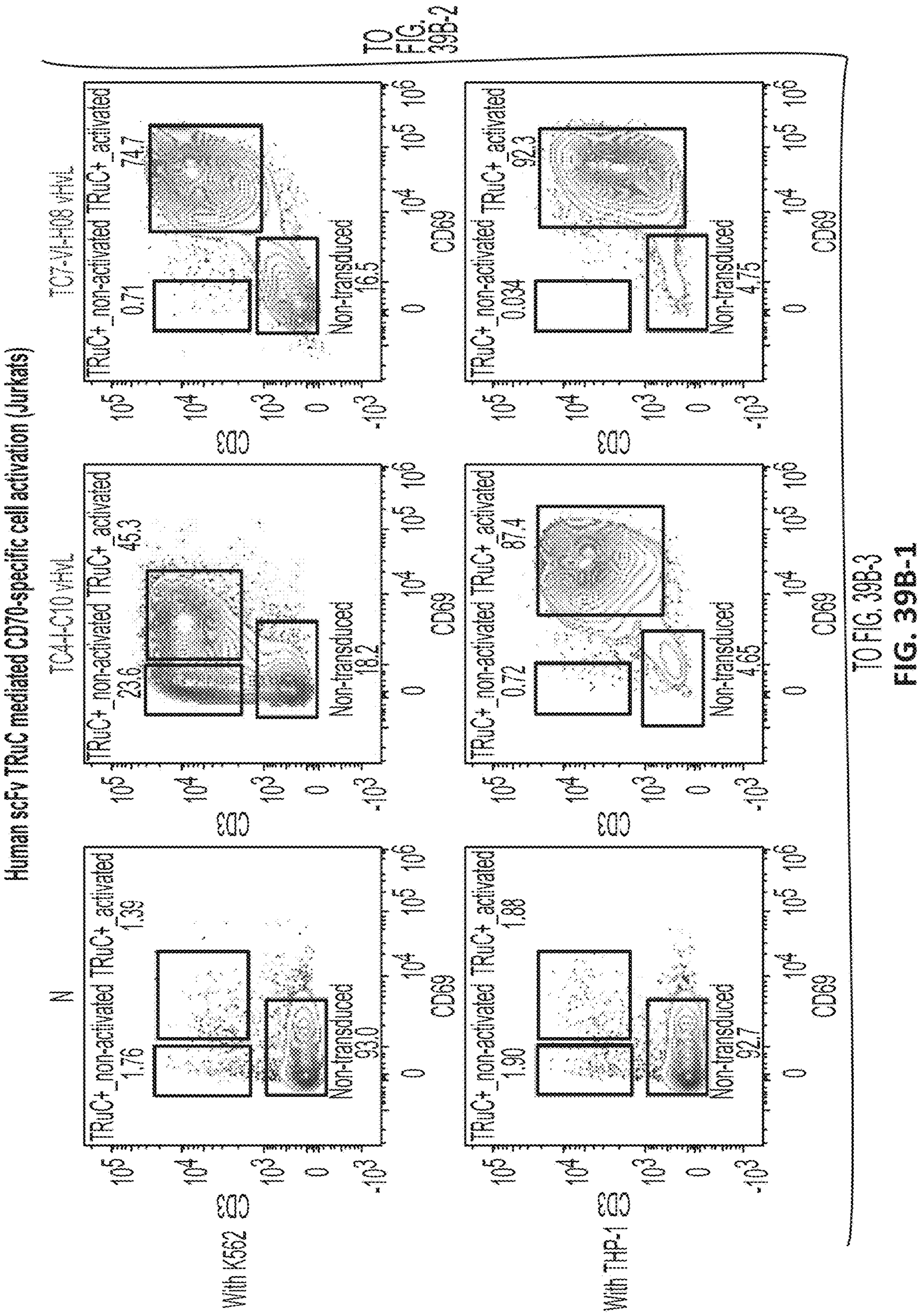
Figures 2, 39B:
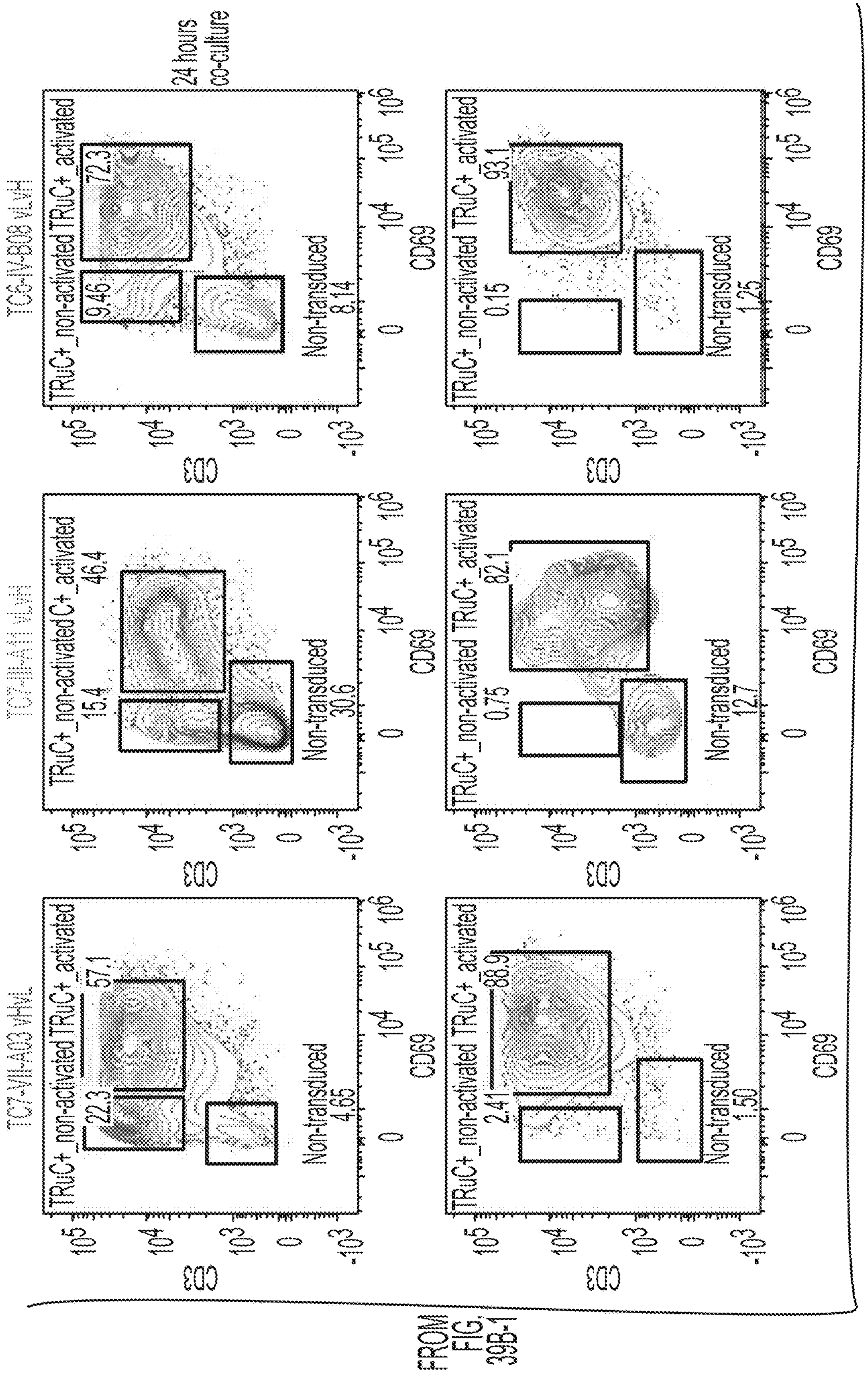
Figures 3, 39B:
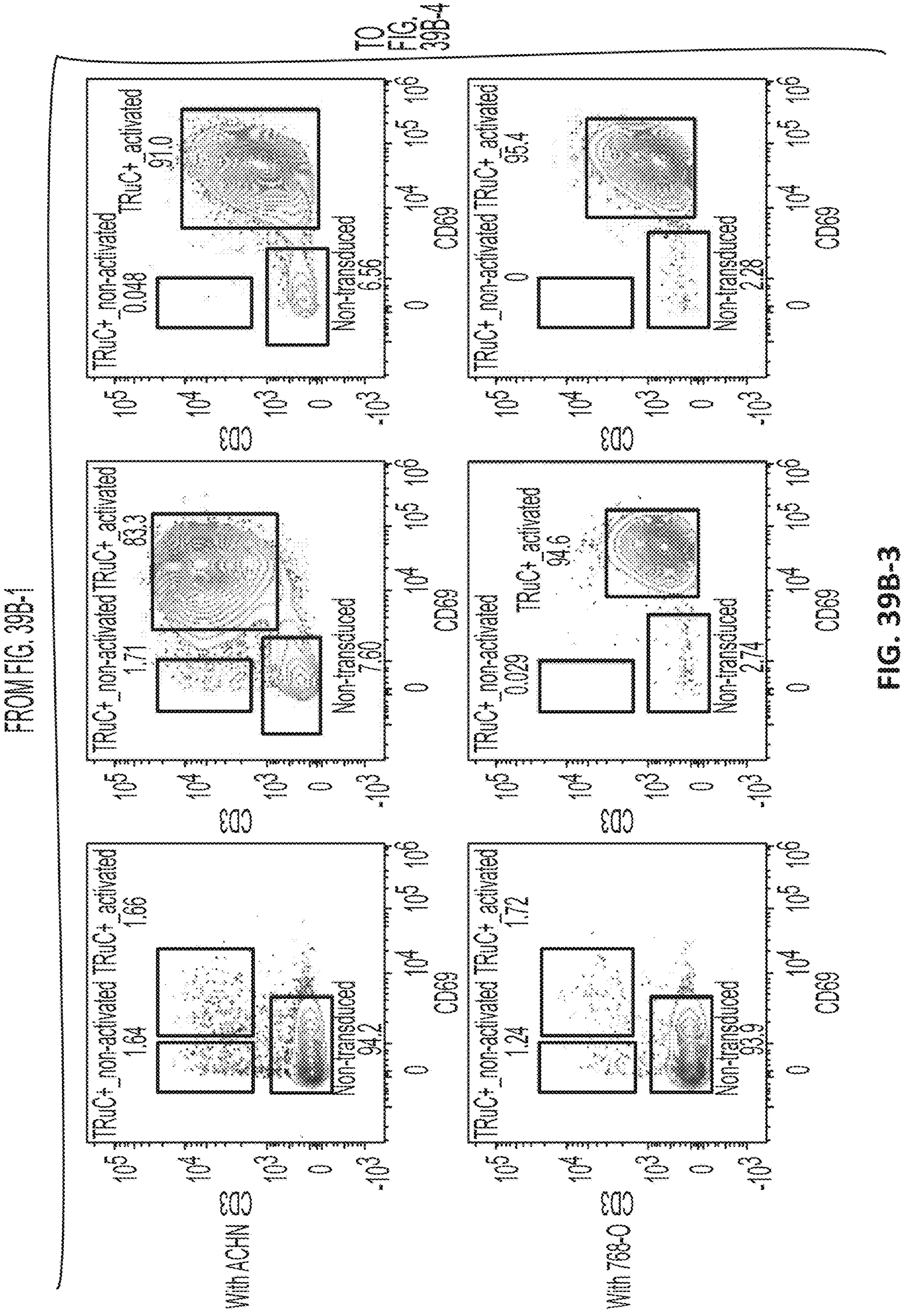
Figures 4, 39B:
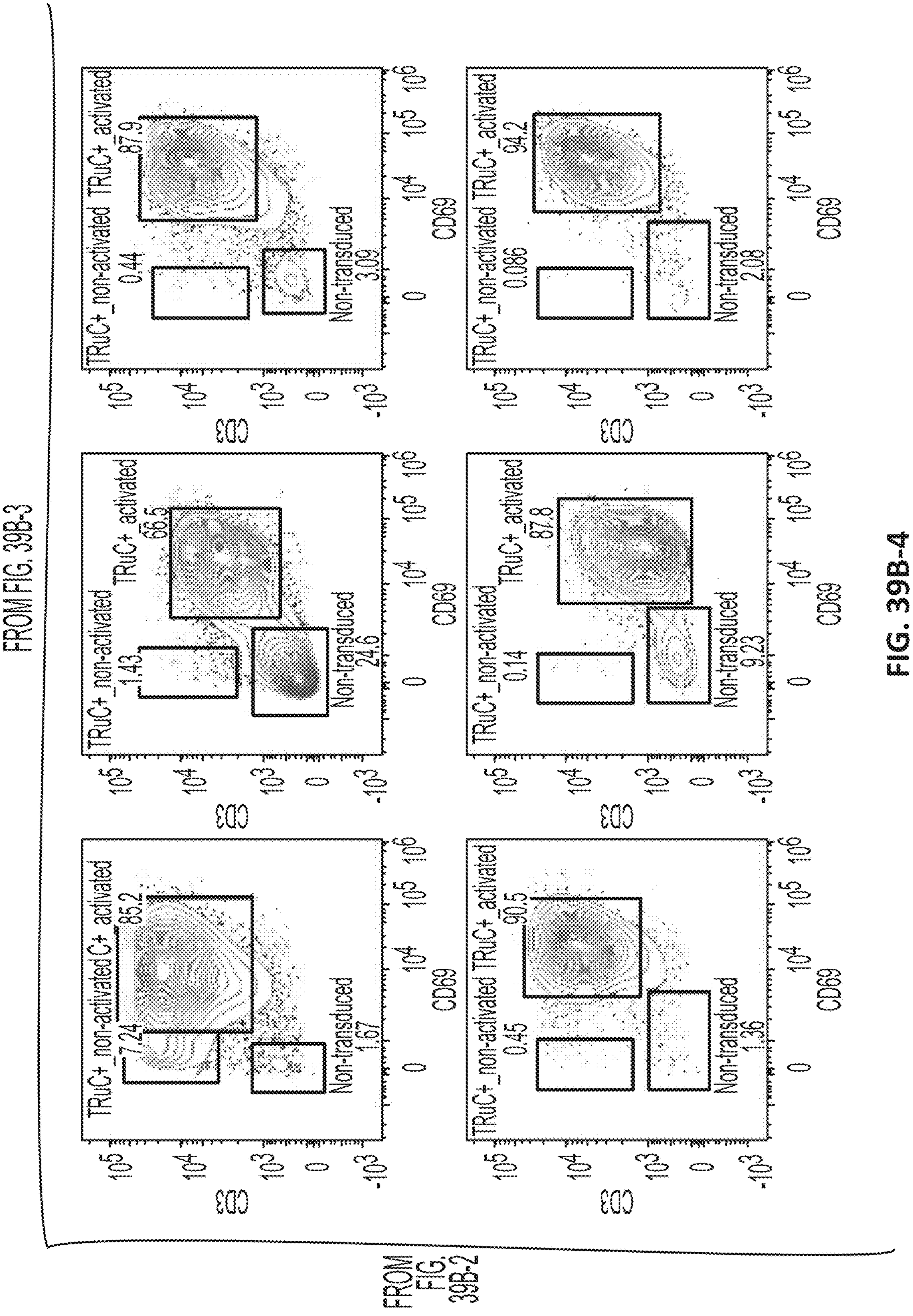

Following expansion, expression of the TFP in Jurkat cells was validated based on detection of CD3 expression in the CD3 epsilon knock-out Jurkat cells. CD69 expression was also assessed as a marker of T cell activation. All constructs showed high transduction efficiency. It was observed that expression of CD70 TFPs expression increased CD69 expression (FIG. 38).

Measurement of Jurkat Cell Activation

CD70 TFP mediated activation of Jurkat cells expressing TFP constructs was assessed by co-culture with CD70-negative K562 cells, CD70-positive THP-1 AML cells, and CD70-positive ACHN cells, and CD70 positive 786-O cells for 24 hours. CD69 expression was assessed by flow cytometry. As is shown in FIG. 39, CD70 TFP expressing Jurkat cells showed increased CD69 expression upon co-culture with CD70 expressing cell lines (THP-1, ACHN, or 786-0) relative to co-culture with K562 cells that do not express CD70.

Figure 40:
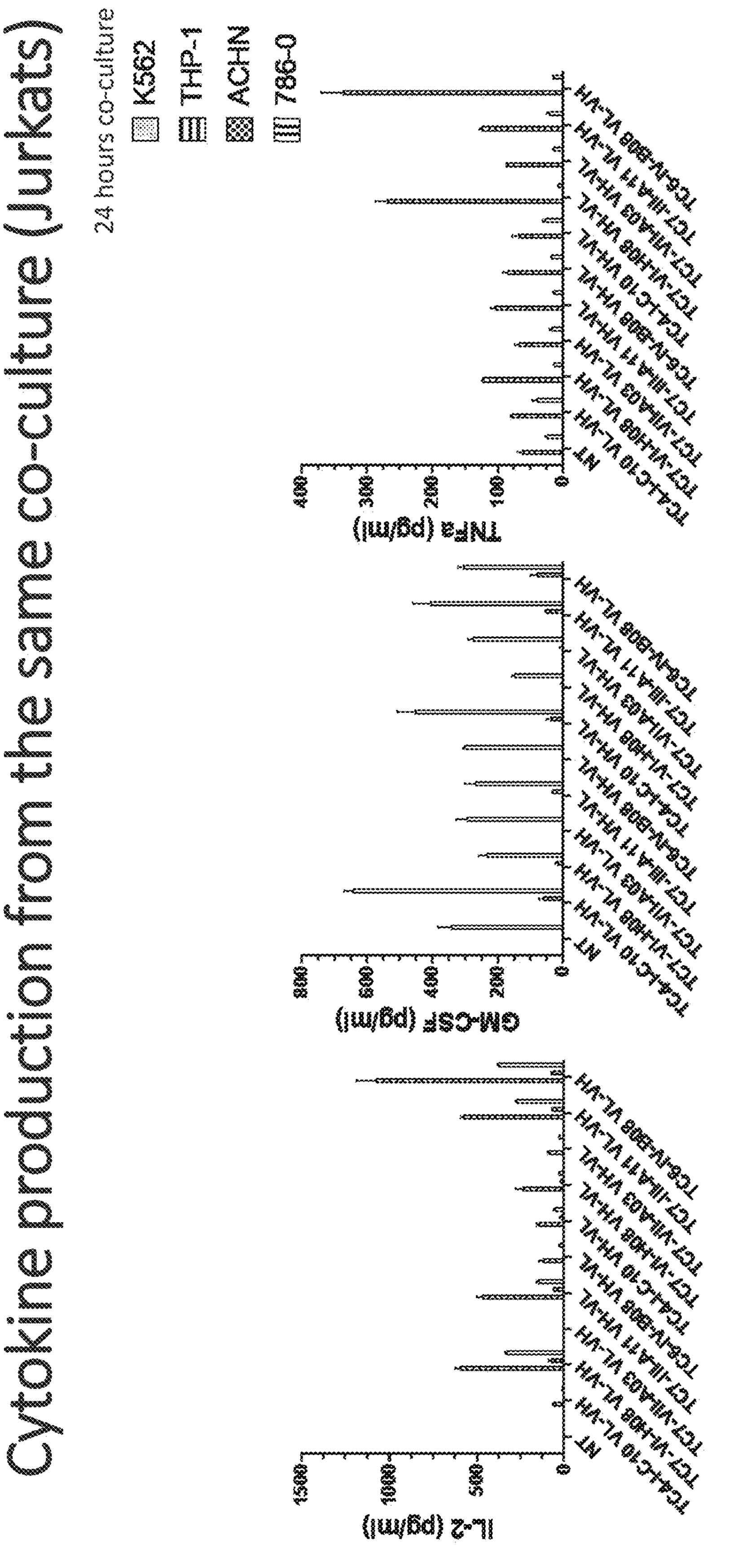
FIG. 40 is a graph showing production of cytokines TNF-α, GM-CSF, and IL-2 by CD3ε knockout jurkat cells transduced with TFPs having the scFv binders shown after co-culture with K562, THP-1, ACHN cells, or 786-O target cells at a 1:1 ratio for 24 hours. CD70 TFP T cells are co-cultured with CD70− K562 cells or CD70+ TFP+, ACHN, or 786-O cells.

Cytokine production was also measured from the same co-culture experiment using the methods described in Example 8. Levels of TNF-α, GM-CSF, and IL-2 were measured. None of the Jurkat cells produced detectable levels of cytokines when contacted with K562 cells that do not express CD70. Jurkat cells transduced with many of the CD70 TFP constructs expressed cytokine levels beyond that of nontransduced cells when contacted with CD70 expressing cell lines THP-1, ACHN, and 786-O (FIG. 40).

Example 16: Generation and Characterization of T Cell Receptor Fusion Protein T Cells As is described above, the cell surface antigen CD70 represents a promising target for cancer immunotherapy for its selective overexpression in various hematological and solid tumor indications. Because the normal tissue expression of CD70 occurs on activated lymphocytes, including activated T cells, fratricide (self-killing) has been recognized as a significant challenge for CD70-targeted T cell therapies. To address this challenge, the diverse pool of fully human anti-CD70 scFv binders described above were used to make TFP T cells and then functionally screened for fratricide-resistance in vitro. A scFv CD70-targeted TFP T cell candidate that exhibits normal T-cell expansion and an improved memory phenotype was identified (C10 TFP), clearly differentiating from fratricide-prone candidates, all while maintaining potent cytotoxicity and cytokine production against tumor cells expressing both low and high levels of CD70. In addition, the scFv CD70 TFP T cells showed potent anti-tumor efficacy in multiple xenograft mouse models (see Example 21) with no evidence of in vivo fratricide. In summary, as is shown below, a fratricide-resistant CD70 TFP T cell therapy has been developed that has the potential to treat a wide range of both hematologic and solid cancers.

Figure 41:
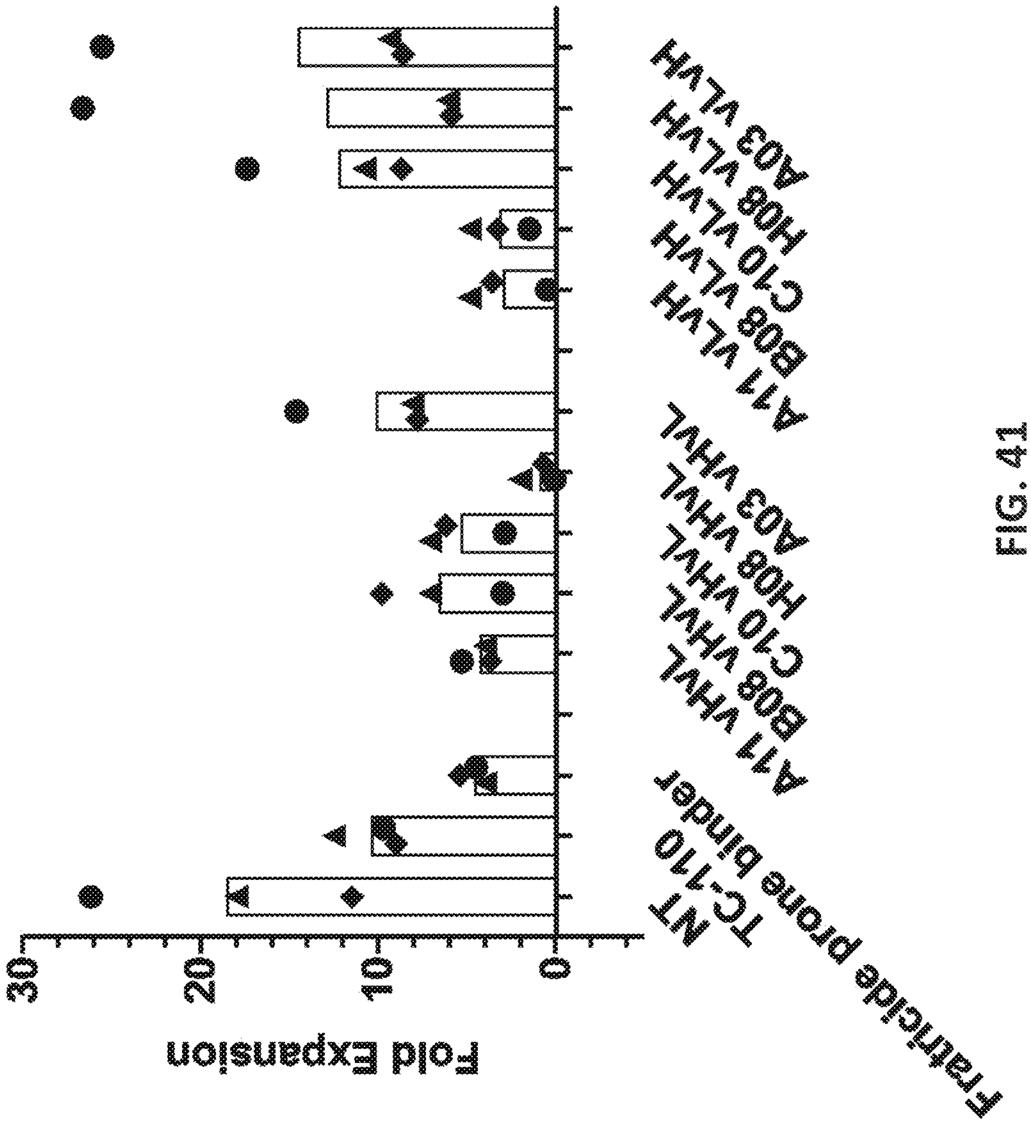
FIG. 41 is a graph showing expansion of T cells transduced with CD 70 TFPs having the scFv binders shown, with the 70-001 CD70 TFP, or with TC-110.

T cells were purified from three healthy donors, transduced with CD3ε TFPs having binders 1-10 shown in Table 2 above, TC-110, or the 70-001 CD3ε TFP according to the methods described in Example 4. T cells having the TFPs indicated were activated and expanded with Human T cell TransAct (Miltenyi Biotech), with recombinant human IL-7 and IL-15, for 10 days. T cell expansion for three donors is shown in FIG. 41. “Fratricide prone binder” indicates the 70-001 TFP. The fold-expansion at the end of the manufacturing process for each tested construct was normalized to the expansion of NT T cells (n=3 donors).

Figure 42:
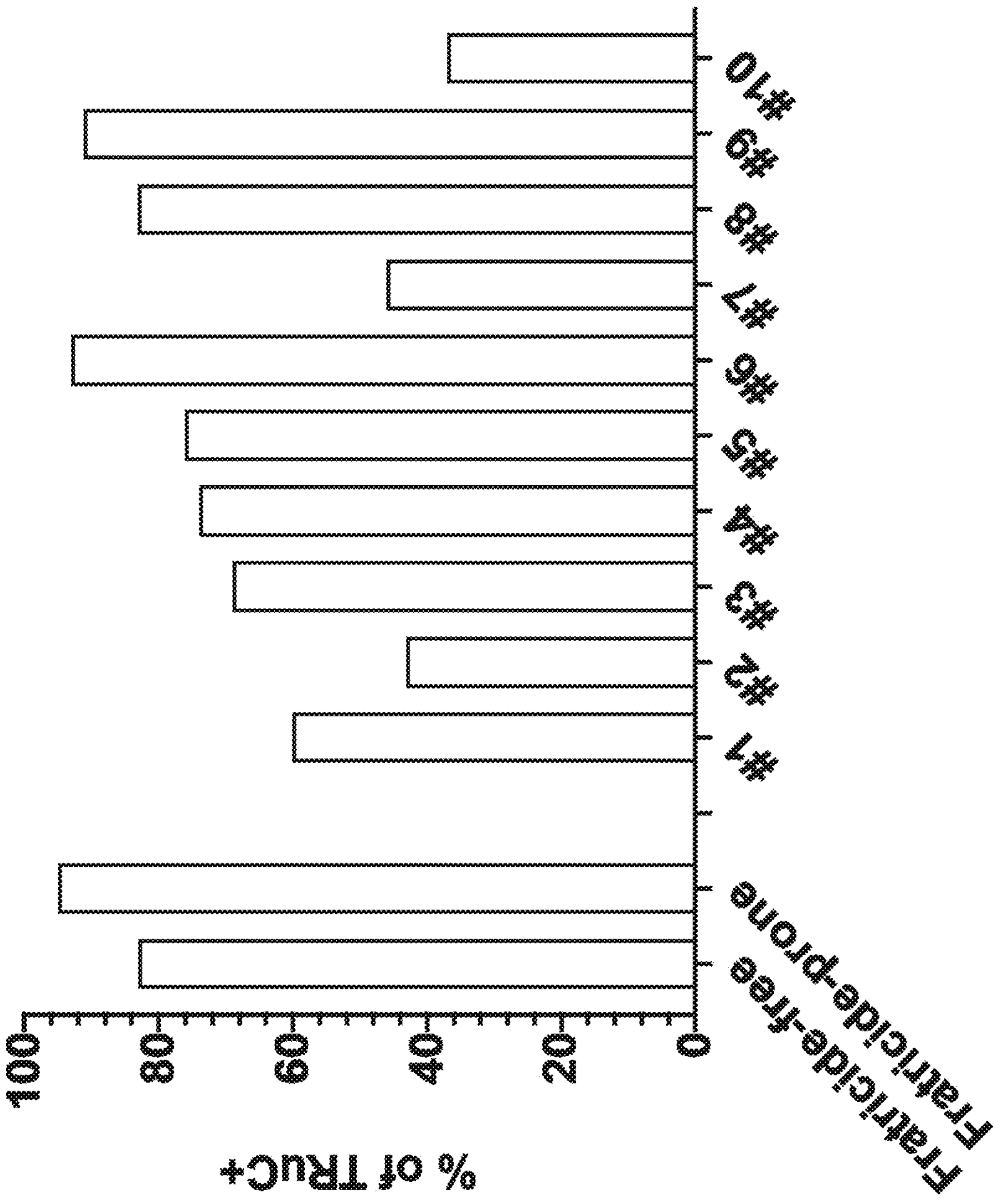
FIG. 42 is a graph illustrating the transduction efficiency of cells transduced with the TFP constructs shown as indicated in Example 16.

Following expansion, transduction efficiency was assessed by flow cytometry. Transduction efficiency was assessed by flow cytometric detection of anti-CD70 binder surface expression using Fc-CD70 protein. “Fratricide free” indicates TC-110 and “fratricide prone” indicates the 70-001 TFP. 1-10 correspond to CD3ε TFPs having binders 1-10 shown in Table 2. As is shown in FIG. 42, high transduction efficiency was achieved with all TFP constructs.

Phenotyping of TFP T Cells

Figure 43:
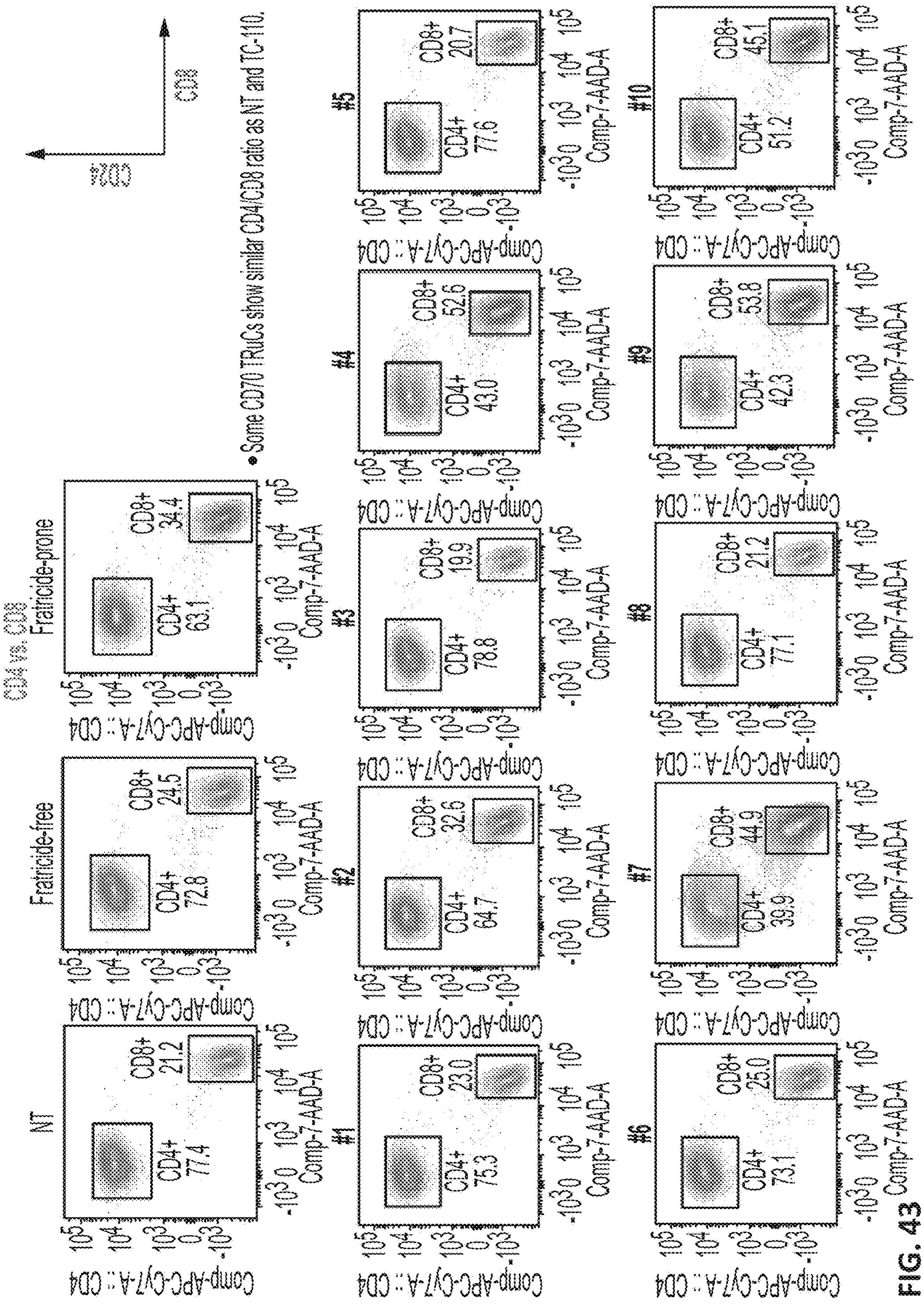
FIG. 43 provides a series of plots showing the proportion of CD4+ and CD8+ T cells in T cell populations transduced with the TFPs shown as indicated in Example 16 or untransduced control T cells. Some CD70 TRuCs show similar CD4/CD8 ratio as NT and TC-110.
Figure 44:
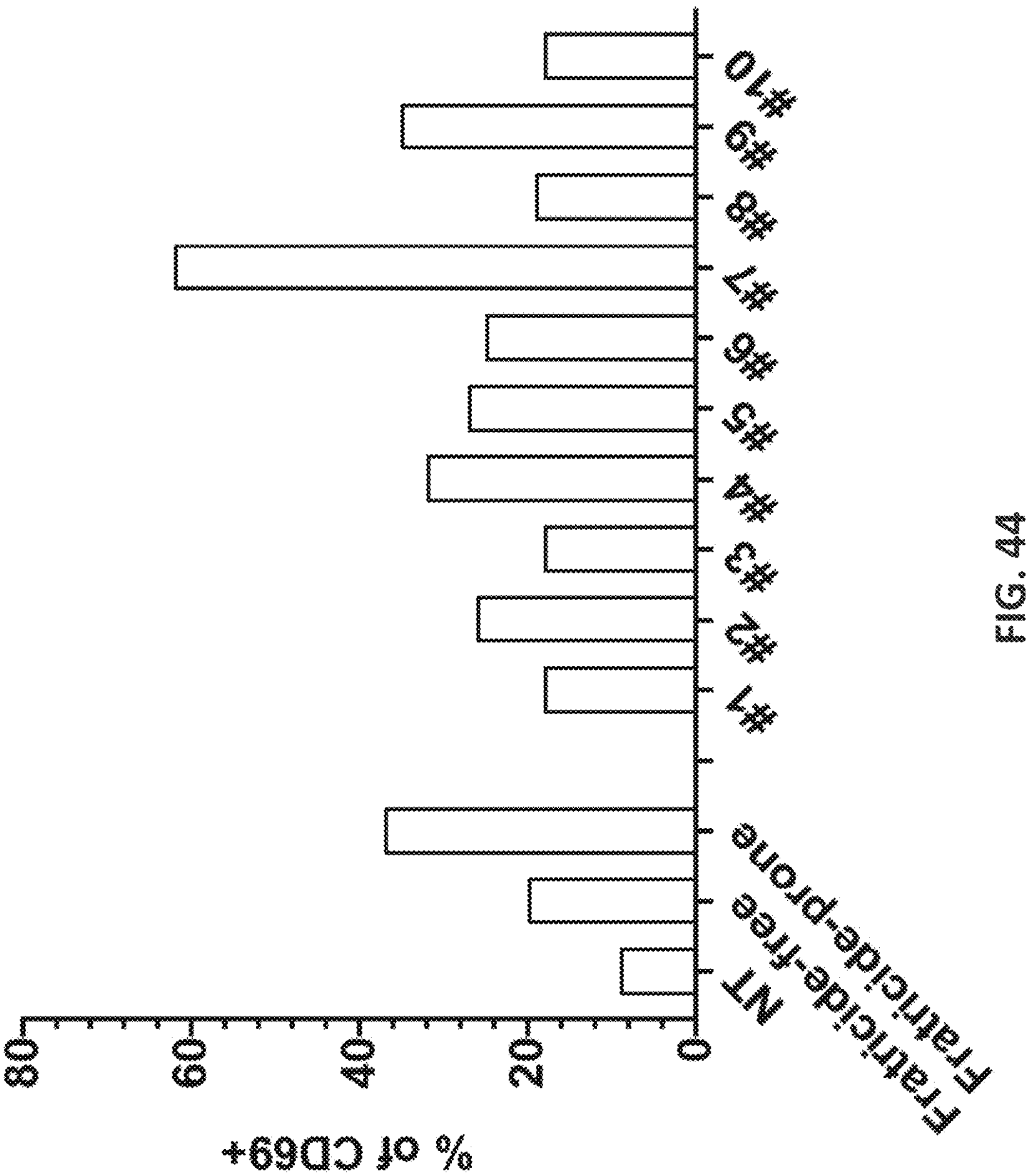
FIG. 44 is a graph showing the proportion of CD69+ T cells transduced with TFPs having the binders shown as indicated in Example 16 or untransduced control T cells.
Figure 45:
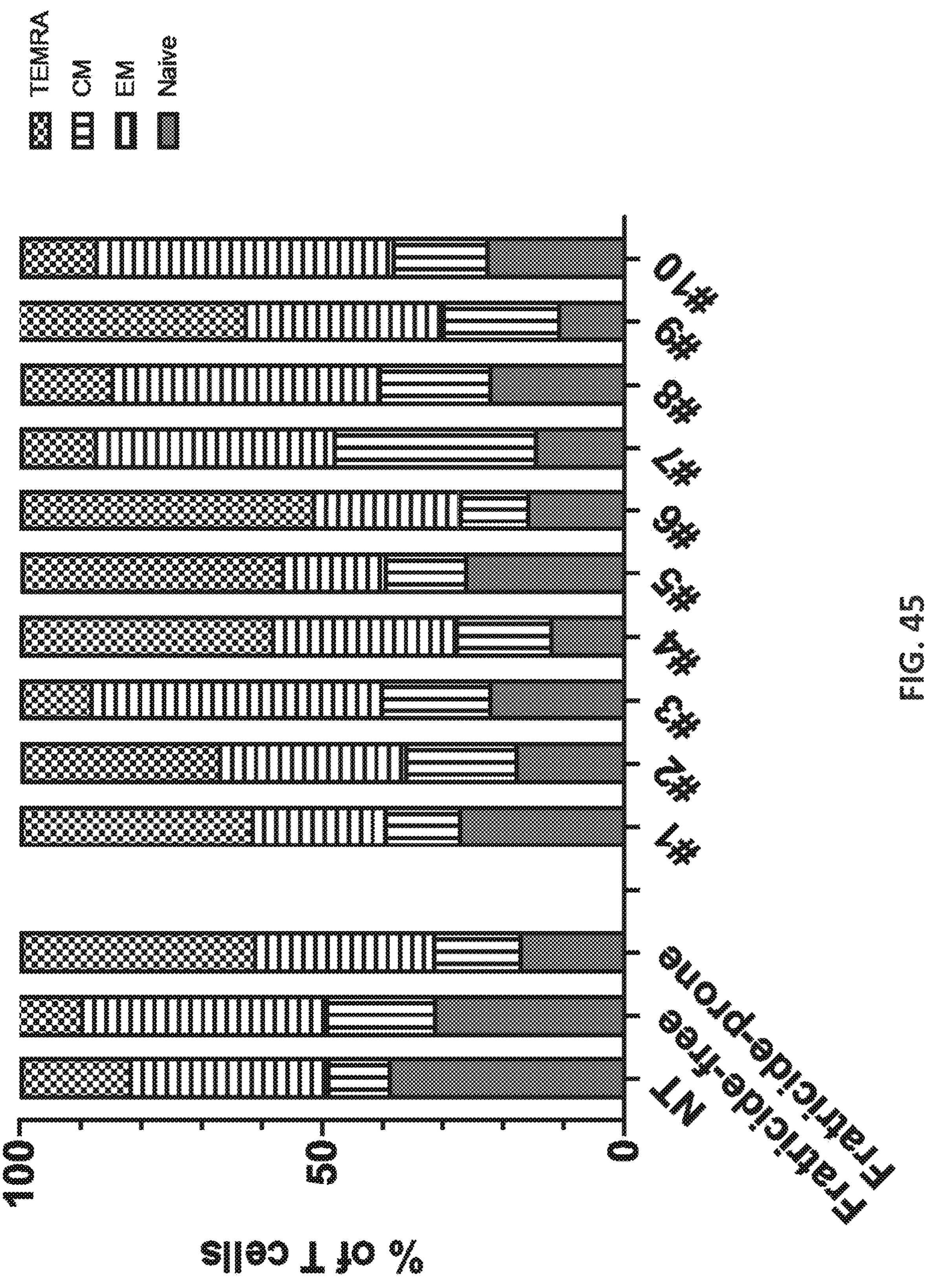
FIG. 45 is a graph showing memory phenotype as determined by flow cytometry detecting cell surface expression of CD45RA and CD27 in T cells transduced with TFPs having the binders shown as indicated in Example 16 or untransduced control T cells.

At day 10 of expansion, T cells were harvested and the cells were characterized by flow cytometry. The ratio of CD4+ to CD8+ T cells for one representative donor is shown in FIG. 43. No significant differences in the ratio of CD4+ to CD8+ T cells between constructs was detected. T-cell activation was evaluated by surface CD69 expression. Data for one representative donor is shown in FIG. 44. High levels of CD69 expression observed for some scFv TFPs (e.g., TC7-VI-H08 vHvL TFP), likely indicating cell activation due to CD70 TFP cis binding, auto-activation, and/or fratricide. T-cell differentiation was determined by surface expression of CD45RA and CCR7 (Naïve, $CD45RA^+$ CCR7$^+$; CM, CD45RA$^-$CCR7$^+$; EM, CD45RA$^-$CCR7$^-$; TEMRA, CD45RA$^+$CCR7$^-$). Data for one representative donor is shown in FIG. 45. Preservation of a naïve T cell population (CD45RA+CCR7+) was observed for several scFv CD70 binder TFPs, including TC4-I-C10 vLvH, TC6-IV-B08 vLvH, and TC6-IV-B08 vHvL. FIG. 46 summarizes the characteristics of each of the human scFv CD70 TFPs.

Cytotoxicity and Cytokine Production of T Cells

Figure 47:
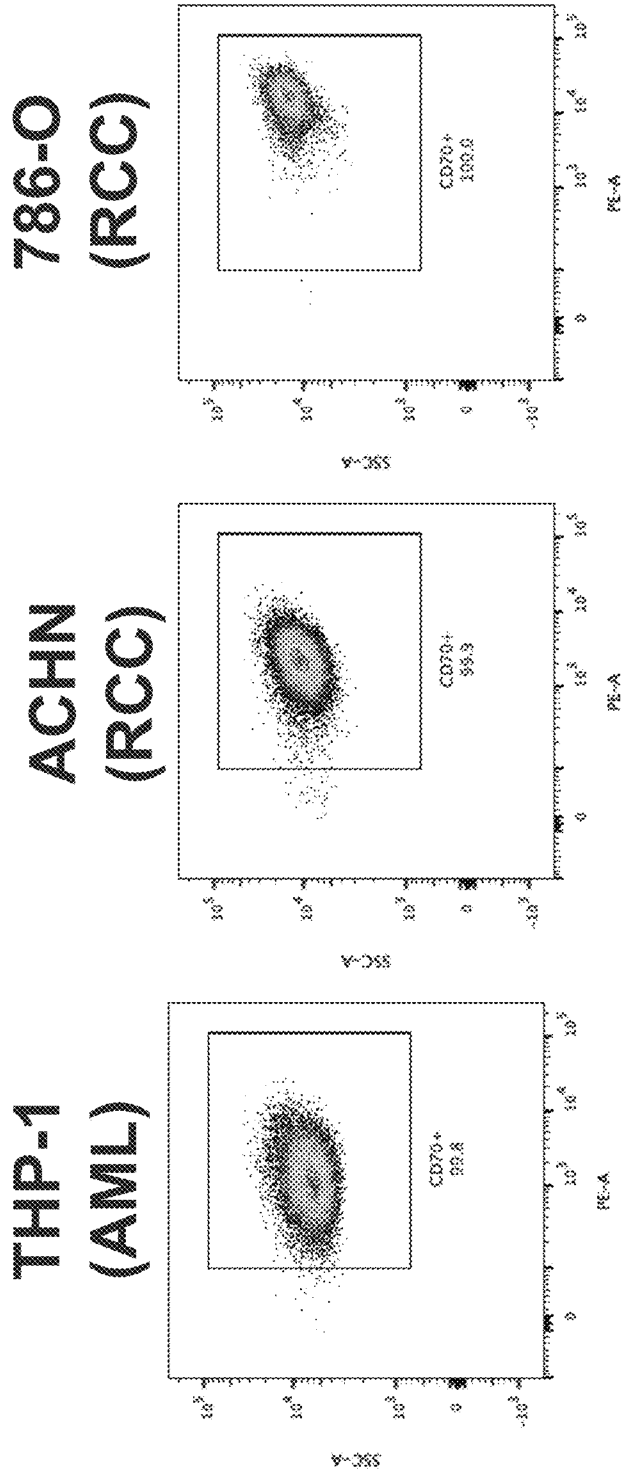
FIG. 47 is a series of plots showing detection of CD70 surface expression in THP-1, ACHN, and 786-O cell lines.

CD70 TFP mediated activation of donor T cells expressing TFP constructs was assessed by assessment of cytotoxicity and cytokine production following co-culture with CD70-negative K562 cells, CD70-positive THP-1 AML cells, and CD70-positive ACHN cells, and CD70 positive 786-O cells. FIG. 47 shows CD70 expression by THP-1, ACHN, and 786-O cell lines, as determined by flow cytometry.

Figure 48:
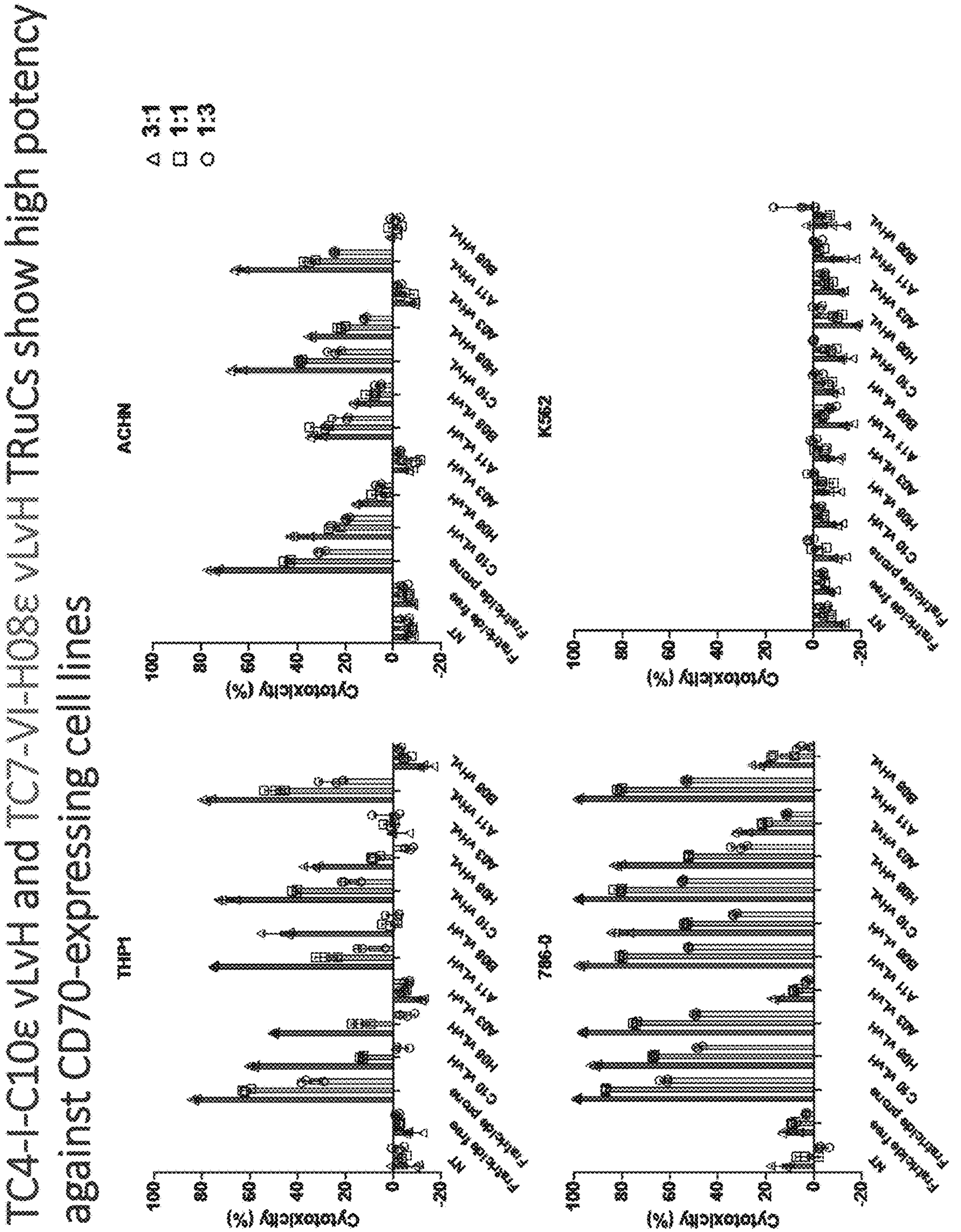
FIG. 48 series of graphs showing cytotoxicity of T cells transduced with TFPs having the binders shown or untransduced control T cells from one representative donor when co-cultured for 24 hours with THP-1, ACHN, 786-0, or K562 cells at a 3:1, 1:1, or 1:3 ratio.
Figure 49A:
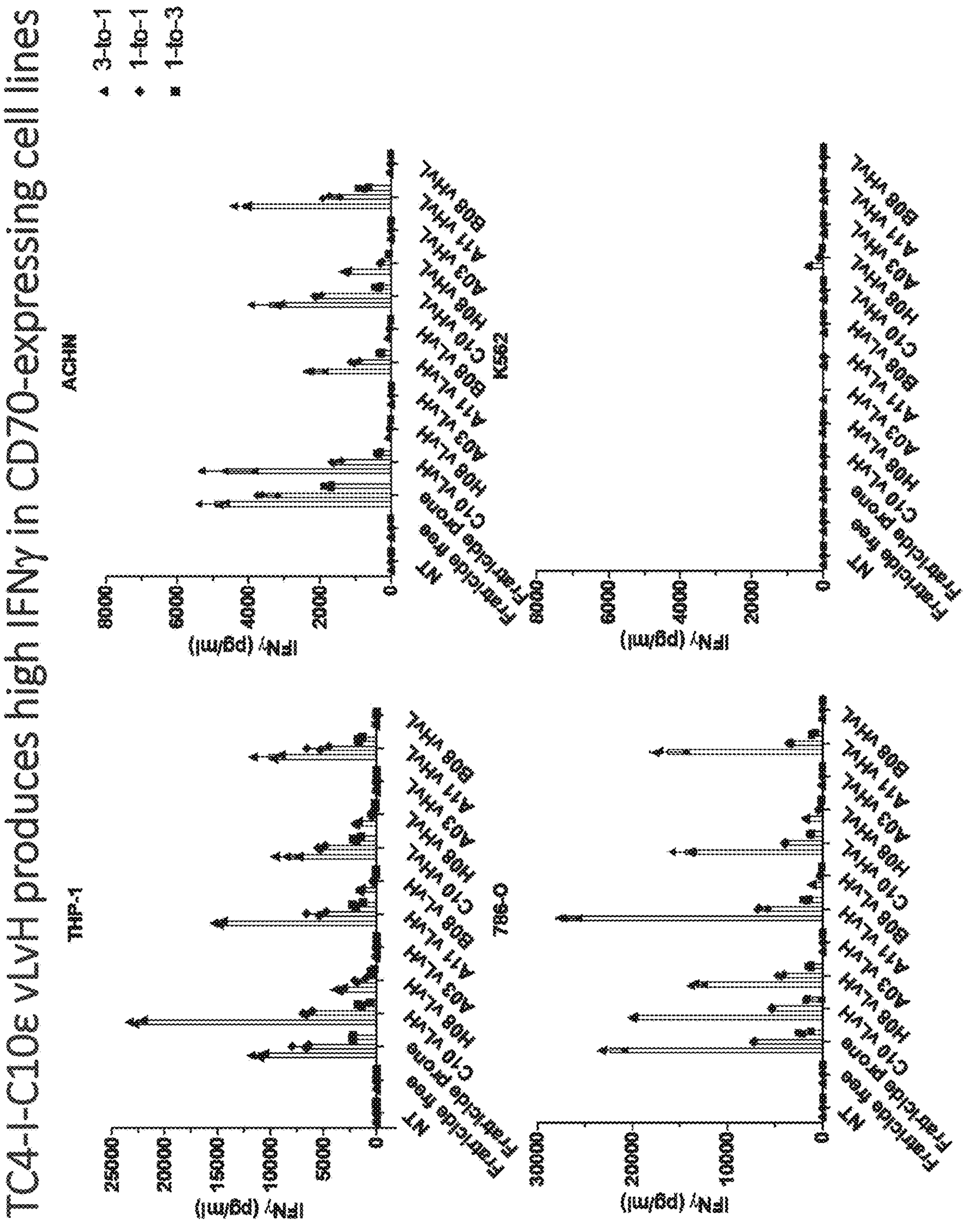
FIGS. 49A-49D are a series of graphs showing cytokine production by T cells transduced with TFPs having the binders shown or untransduced control T cells from one representative donor when co-cultured for 24 hours with THP-1, ACHN, 786-0, or K562 cells at a 3:1, 1:1, or 1:3 ratio. IFN-γ (FIG. 49A), IL-2 (FIG. 49B), TNF-α (FIG. 49C), and GM-CSF (FIG. 49D) were measured.
Figure 49B:
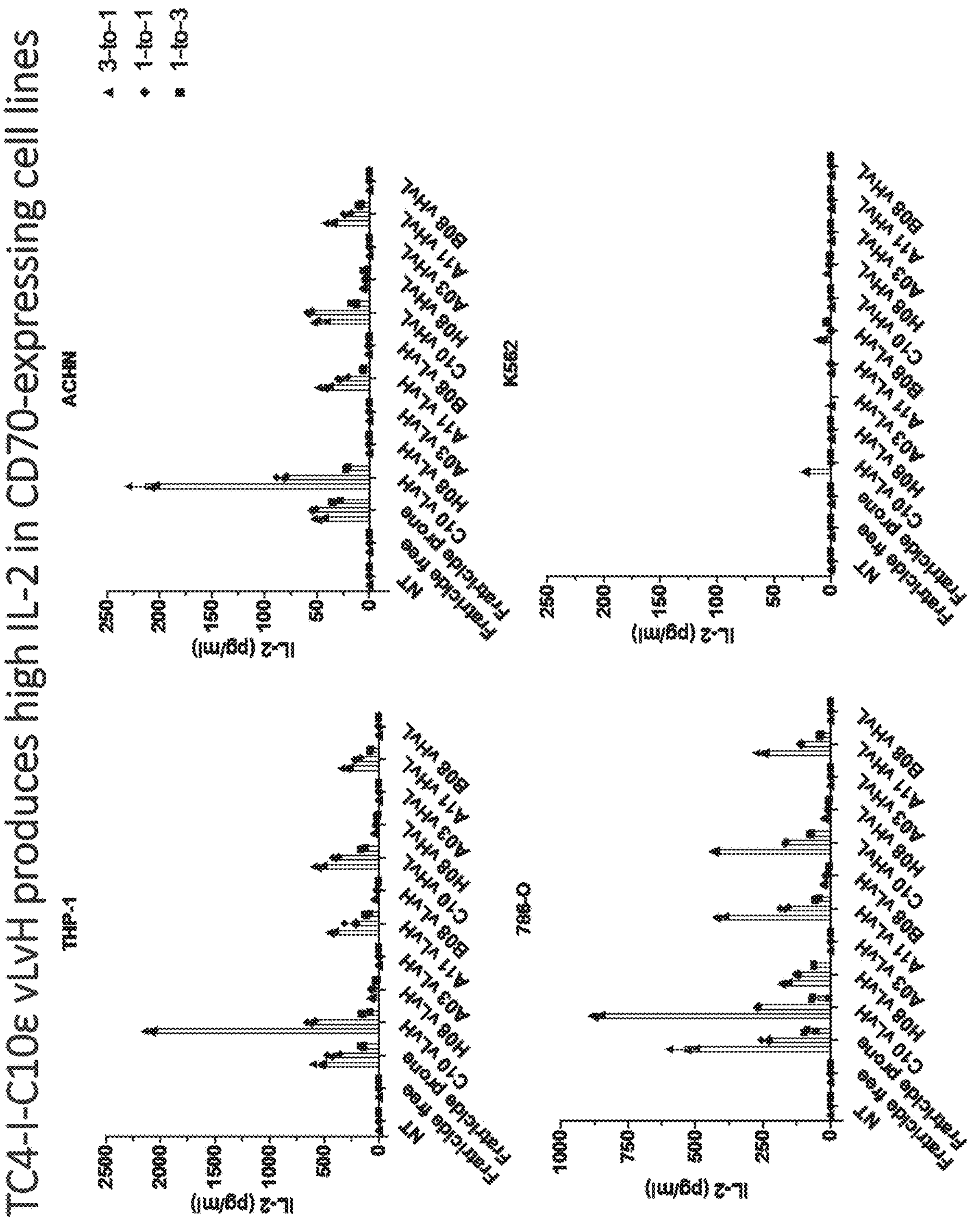
Figure 49C:
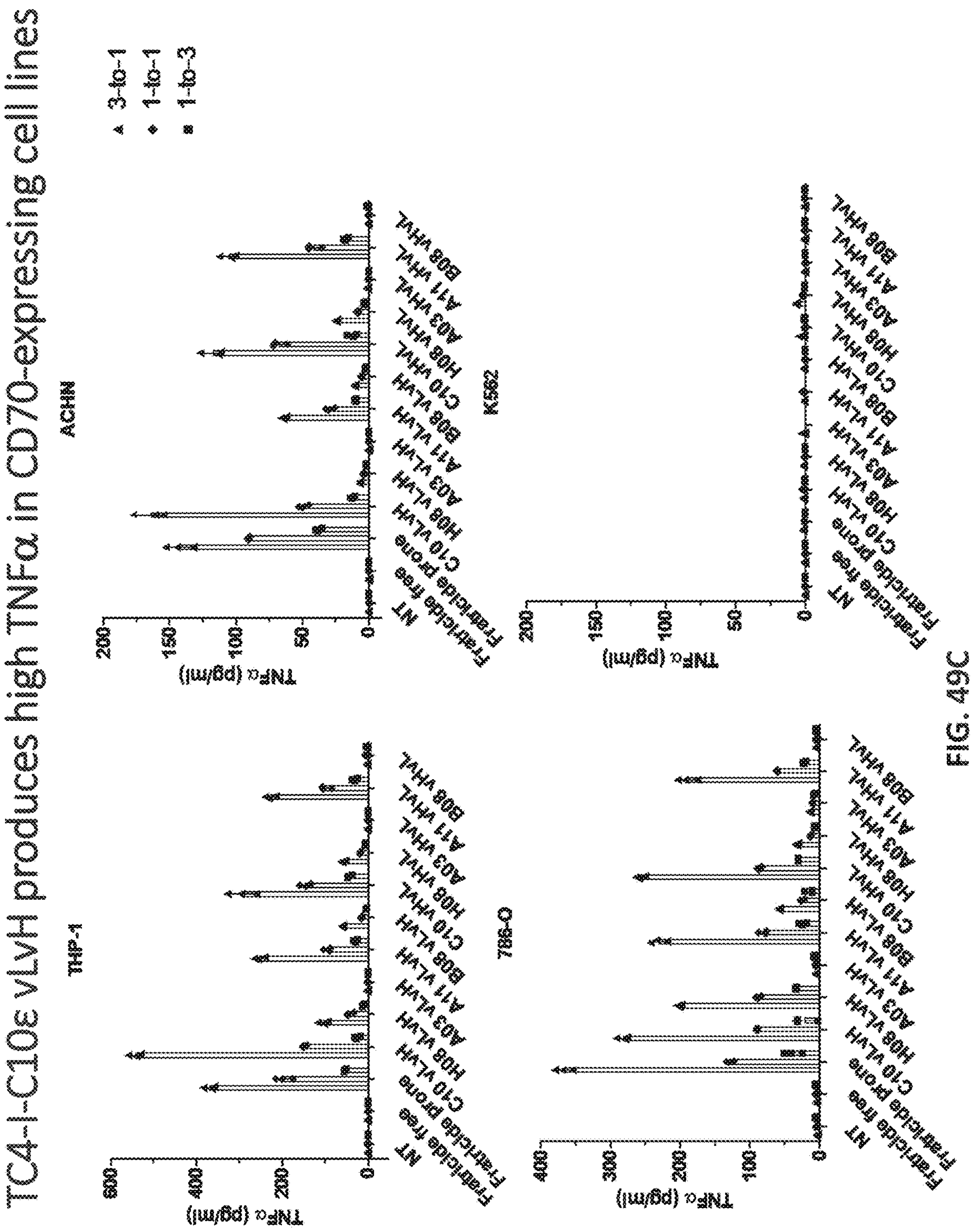
Figure 49D:
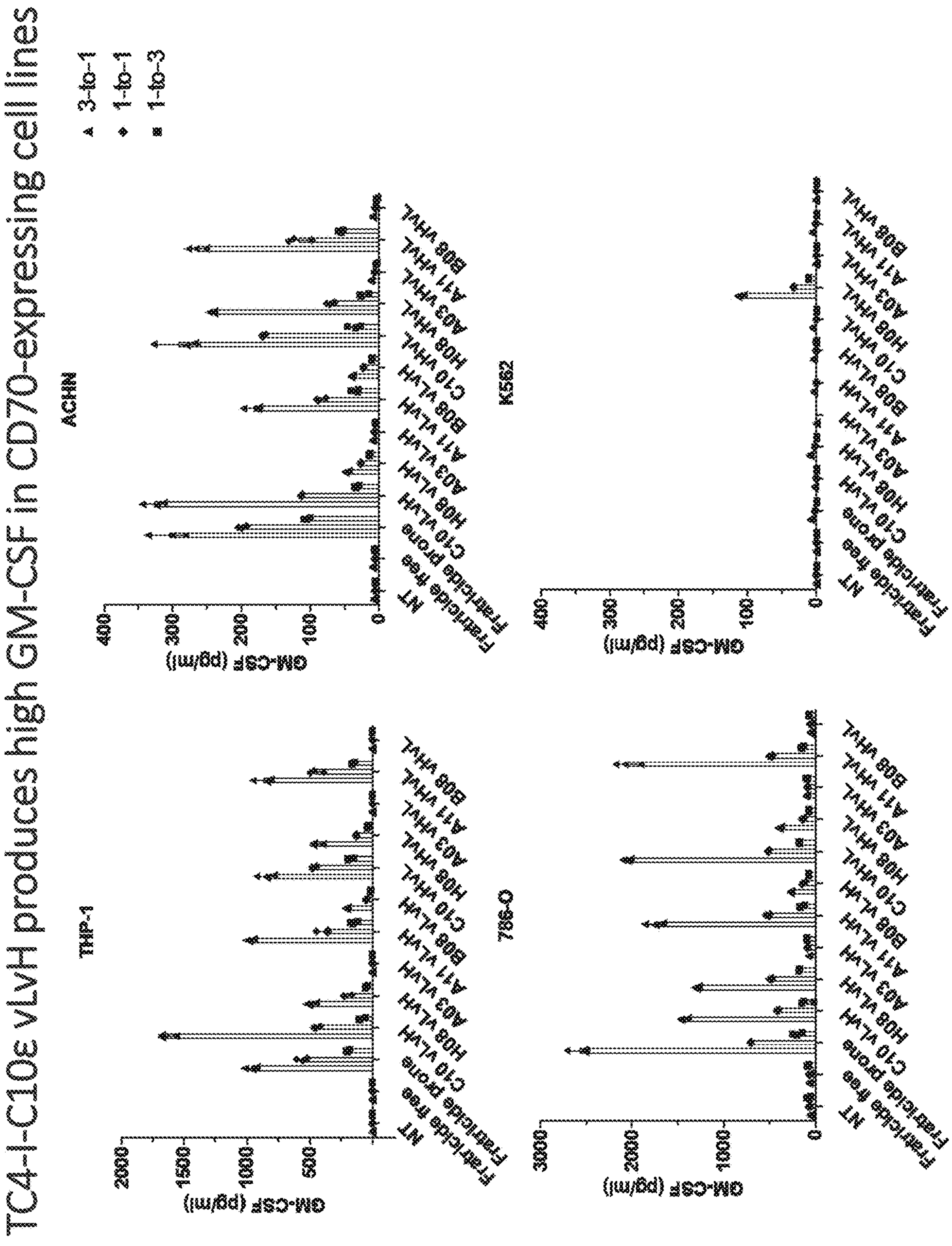

Cytotoxicity was measured as is described in Example 7. CD70 TFP expressing T cells or controls were co-cultured with luciferase expressing THP-1, ACHN, 786-0, or K562 cells at a 3:1, 1:1, or 1:3 ratio for 24 hours. The luciferase activity in live target cells was then measured and cytotoxicity calculated as described above. Data for one representative donor is shown in FIG. 48. As is shown, T cells expressing many of the scFv CD70 TFPs exhibited cytotoxicity towards CD70– expressing cells but not towards K562 cells, which do not express CD70. In particular, scFv CD70 binder TFPs, including TC4-I-C10 vLvH, TC7-VI-H08 vLvH, TC7-III-A11 vLvH, TC6-IV-B08 vLvH, TC4-I-C10 vHvL, TC7-VI-H08 vHvL, and TC7-III-A11 vHvL exhibited high levels of cytotoxicity towards CD70-expressing cell lines THP-1, ACHN, and 786-0.

Cytokine production was also measured from the same co-culture experiment using the methods described in Example 8. Levels of IFN-γ, TNF-α, GM-CSF, and IL-2 were detected. Representative data for one donor is shown in FIG. 49. T cells expressing scFv CD70 binder TFPs, including TC4-I-C10 vLvH, TC7-III-A11 vLvH, TC4-I-C10 vHvL, and TC7-III-A11 vHvL exhibited high levels of IFN-γ, TNF-α, GM-CSF, and IL-2 expression when co-cultured with CD70– expressing cell lines THP-1, ACHN, and 786-O and did not express cytokines when co-cultured with CD70– K562 cells.

Example 17: Generation of CD70 TFPs with Humanized VHH Binding Domains

Humanized CD70 VHH TFPs were generated by humanizing the 70-001 binder to generate humanized VHH anti-CD70 antigen binding domains having SEQ ID NOs: 1224-1227. Anti-CD70 TFP constructs were engineered by cloning the CD70 VHH DNA fragment linked to a CD3 or TCR DNA fragment by either a DNA sequence encoding a short linker (SL): AAAGGGGSGGGGSGGGGSLE (SEQ ID NO:692) or a long linker (LL): AAAIEVMYPPPYLGGGGSGGGGSGGGGSLE (SEQ ID NO:693) into a lentiviral vector. Various other vector may be used to generate fusion protein constructs. TCR subunits that can be used are described in Example 3 above. Data presented in this example also includes data for the human scFv binders TC1.2-I-F07-6 and TC7-VII-C02 from Example 12 above.

Figure 50:
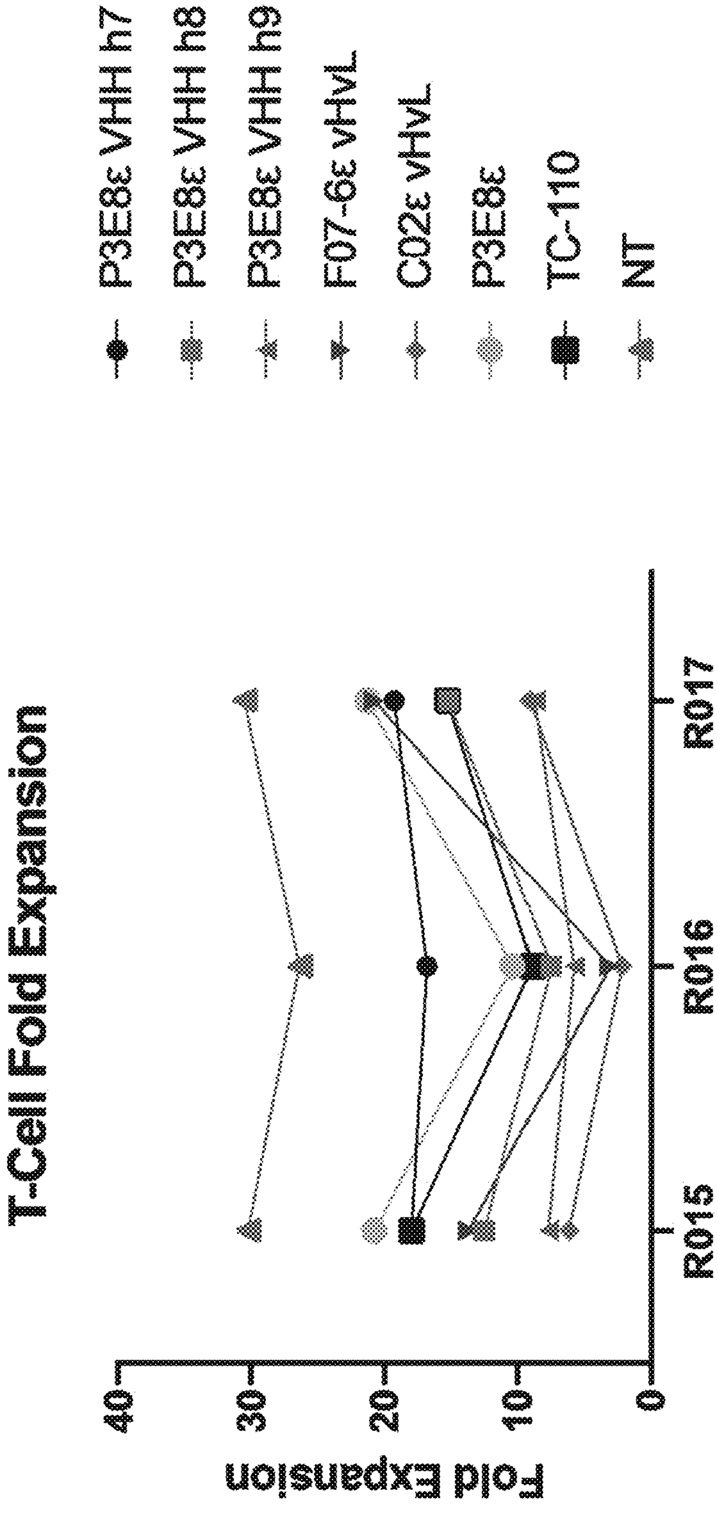
FIG. 50 is a graph showing expansion of T cells from three donors transduced with the CD 70 TFPs having scFv or humanized VHH binders shown, or 70-001 CD70 TFP (P3E8), TC-110, or untransduced controls.
Figure 57:
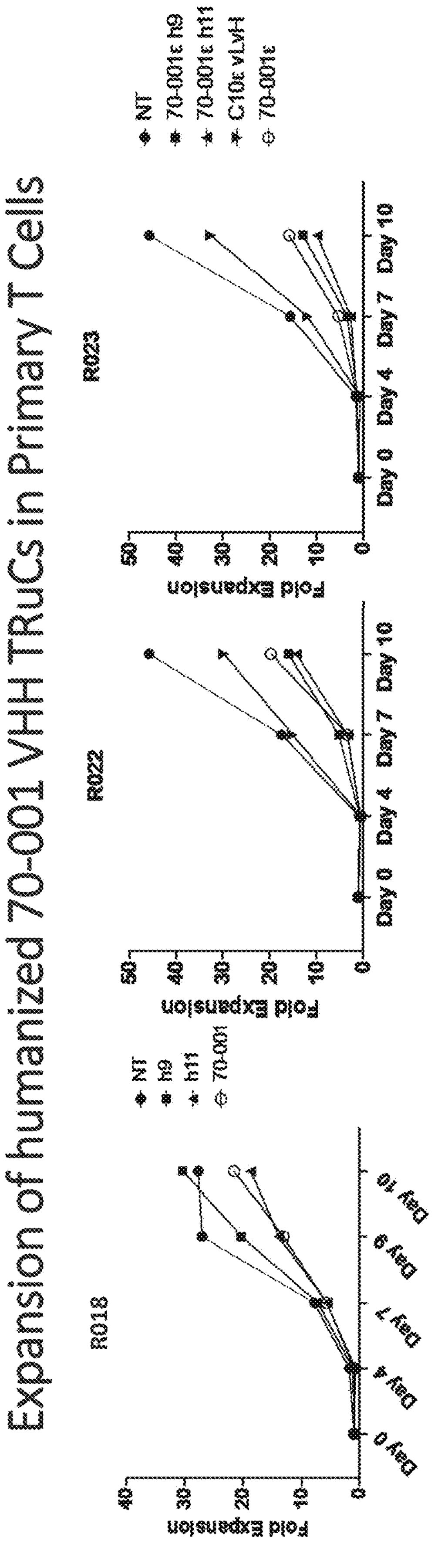
FIG. 57 is a series of graphs showing expansion of T cells from three donors transduced with the CD 70 TFPs having scFv or humanized VHH binders shown, or 70-001 CD70 TFP (P3E8), C10 TFP, or untransduced controls.

T cells were purified from three healthy donors, transduced with TC-110 (FMC63 anti-CD19 with CD3ε), CD3ε TFPs having VHH binder 70-001 (P3E8), humanized VHH binders h7, h8, h9, or h11, human scFv binders TC1.2-I-F07-6 (F07-6), TC7-VII-C02 (C02), or TC4-I-C10 vLvH (C10), according to the methods described in Example 4. T cells having the TFPs indicated were activated and expanded with Human T cell TransAct (Miltenyi Biotech), with recombinant human IL-7 and IL-15, for 10 days. T cell expansion for three donors for TFPs having binders 70-001, h7, h8, h9, C02, F07-6, TC-110, and non-transduced cells is shown in FIG. 50. T cell expansion for three donors for TFPs having binders 70-001, h9, hi 1, C10, and non-transduced cells is shown in FIG. 57.

Verification of TFP Expression by Cell Staining

Figure 51A:
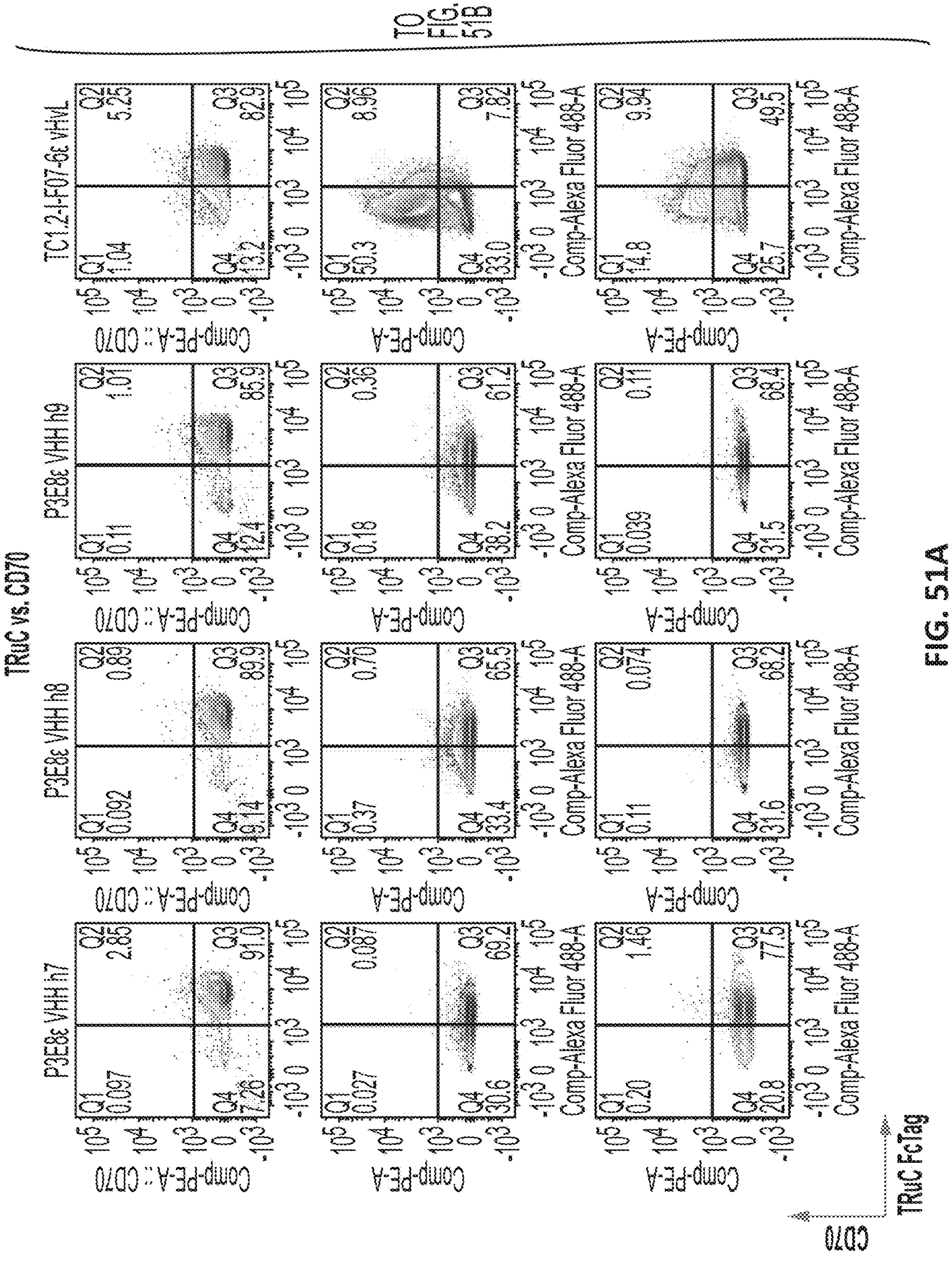
FIG. 51 is series of plots showing cell surface CD70 expression and transduction efficiency as determined by detection of VHH expression in T cells from three donors transduced with the CD 70 TFPs having scFv or humanized VHH binders shown, or 70-001 CD70 TFP (P3E8), TC-110, or untransduced controls.
Figure 51B:
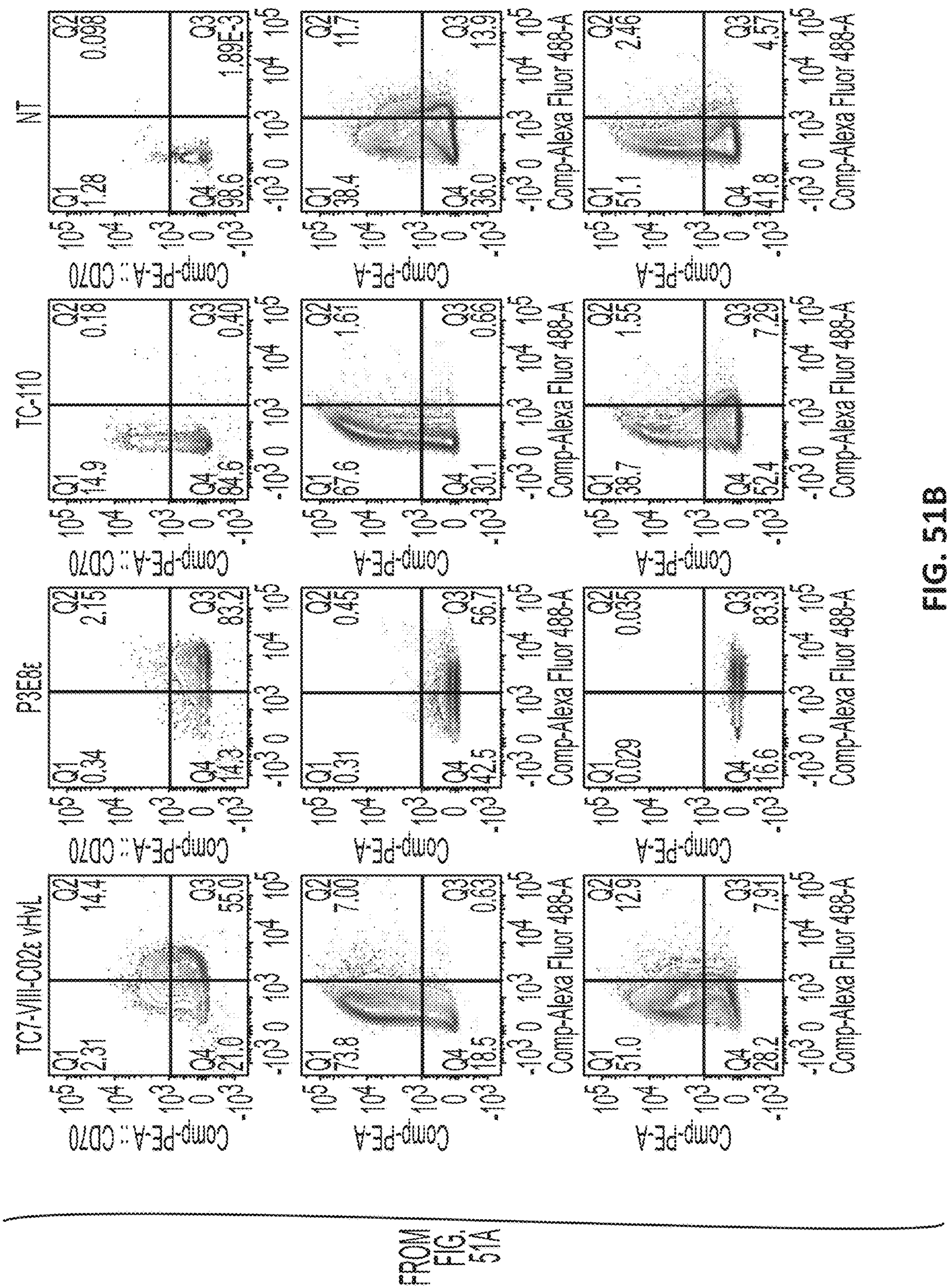
Figure 52A:
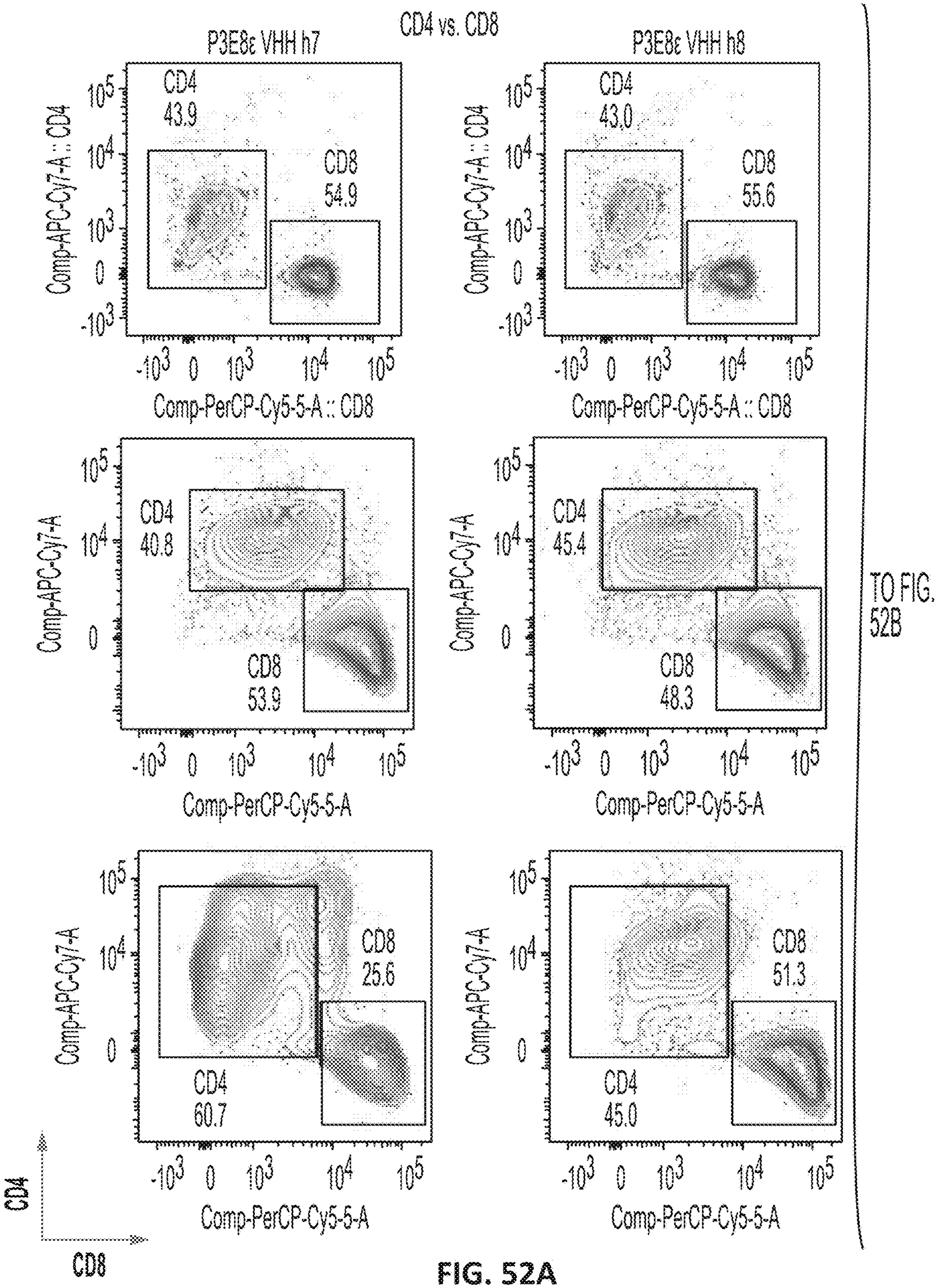
FIG. 52 is a series of plots showing flow cytometry data detecting CD4+ and CD8+ positivity in T cells from three donors transduced with the CD 70 TFPs having scFv or humanized VHH binders shown, or 70-001 CD70 TFP (P3E8), TC-110, or untransduced controls.
Figure 52B:
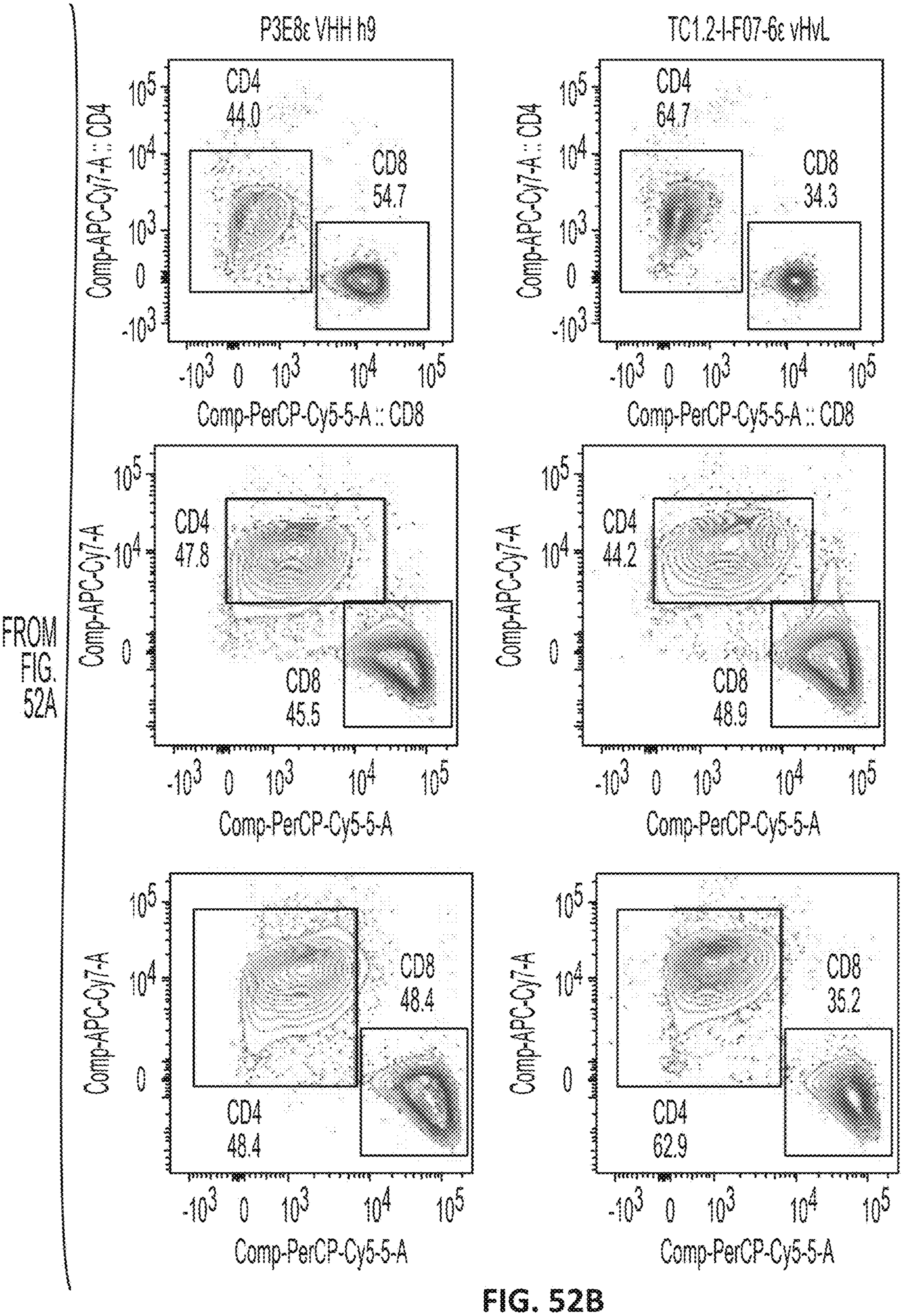
Figure 52C:
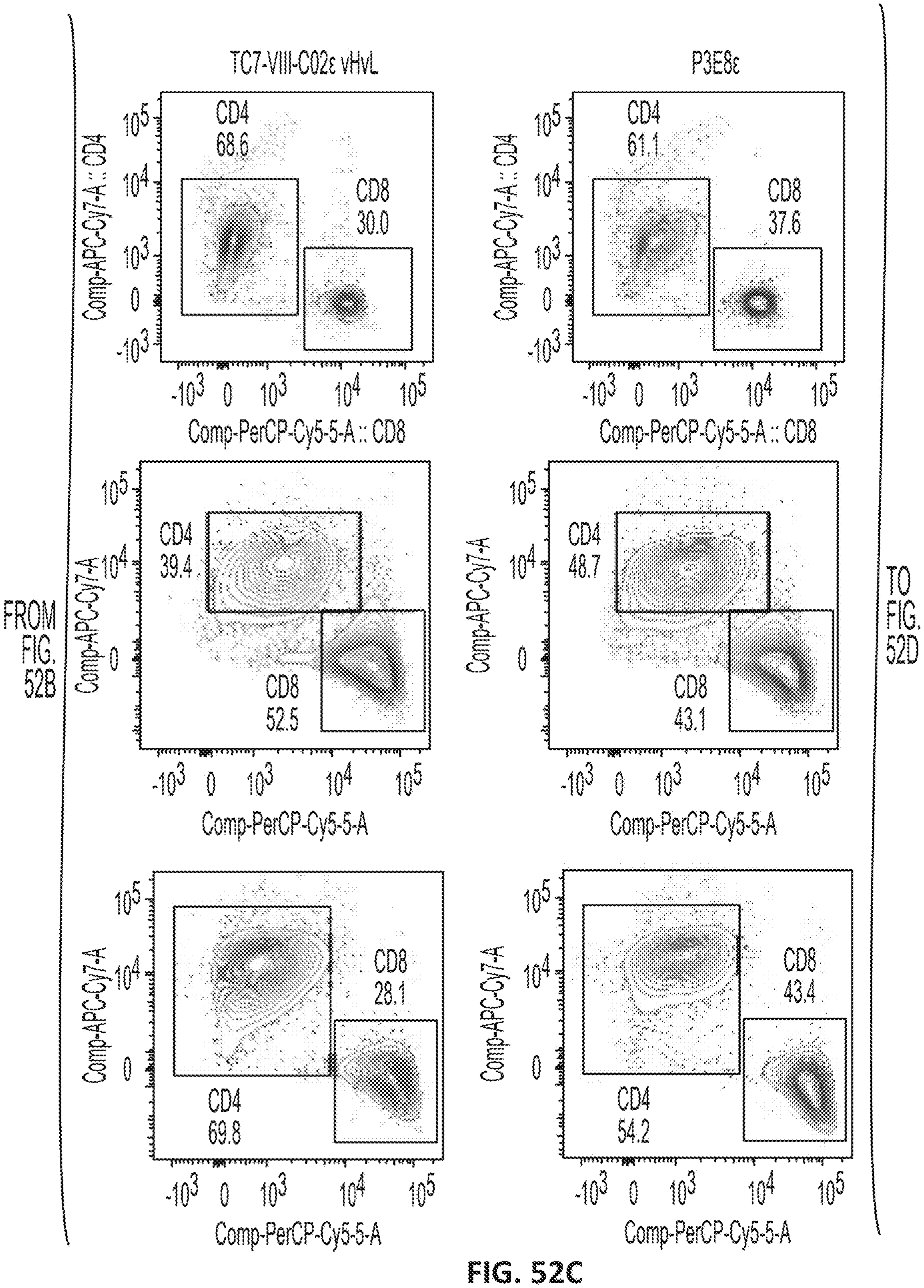
Figure 52D:
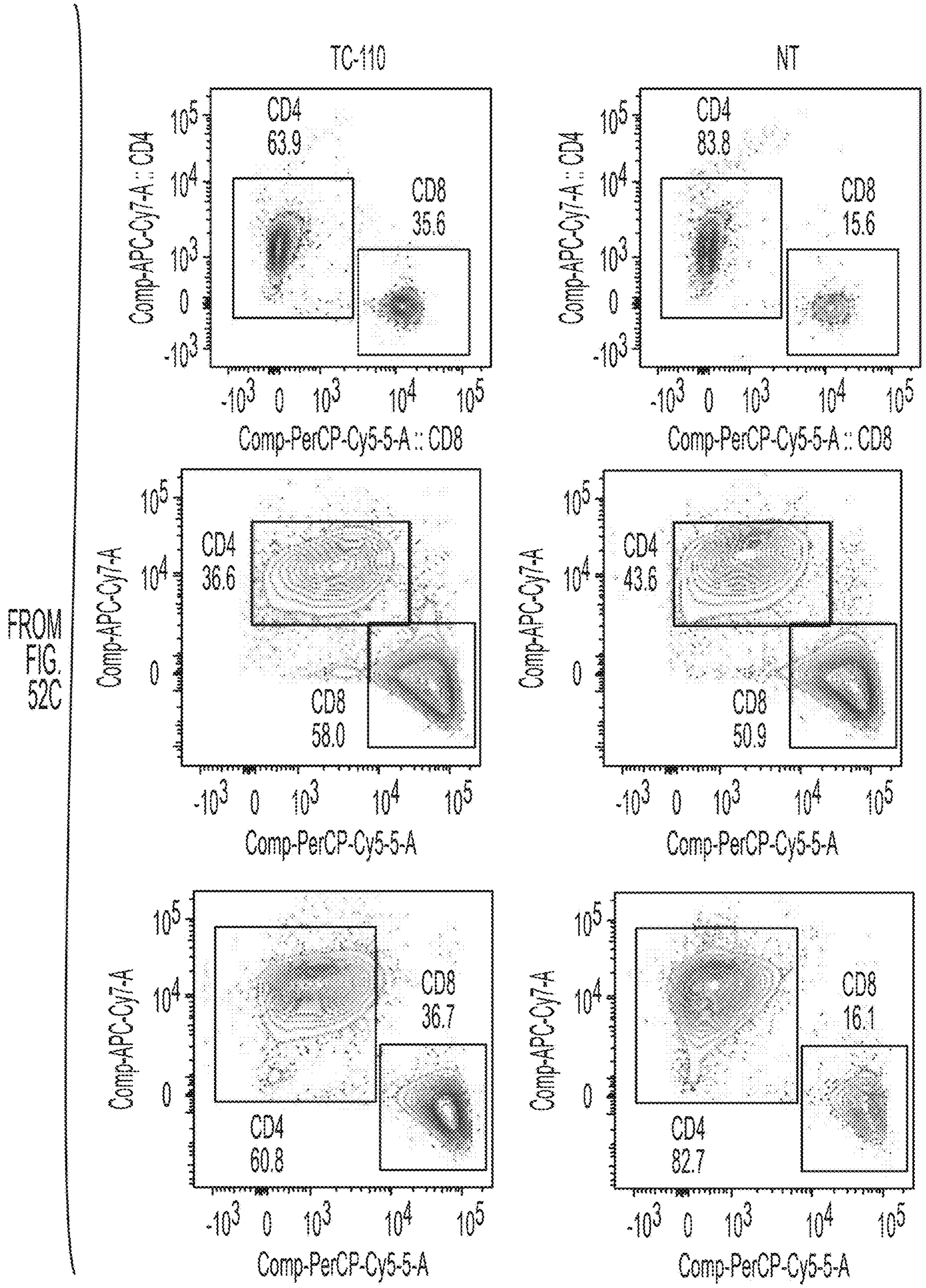
Figure 58:
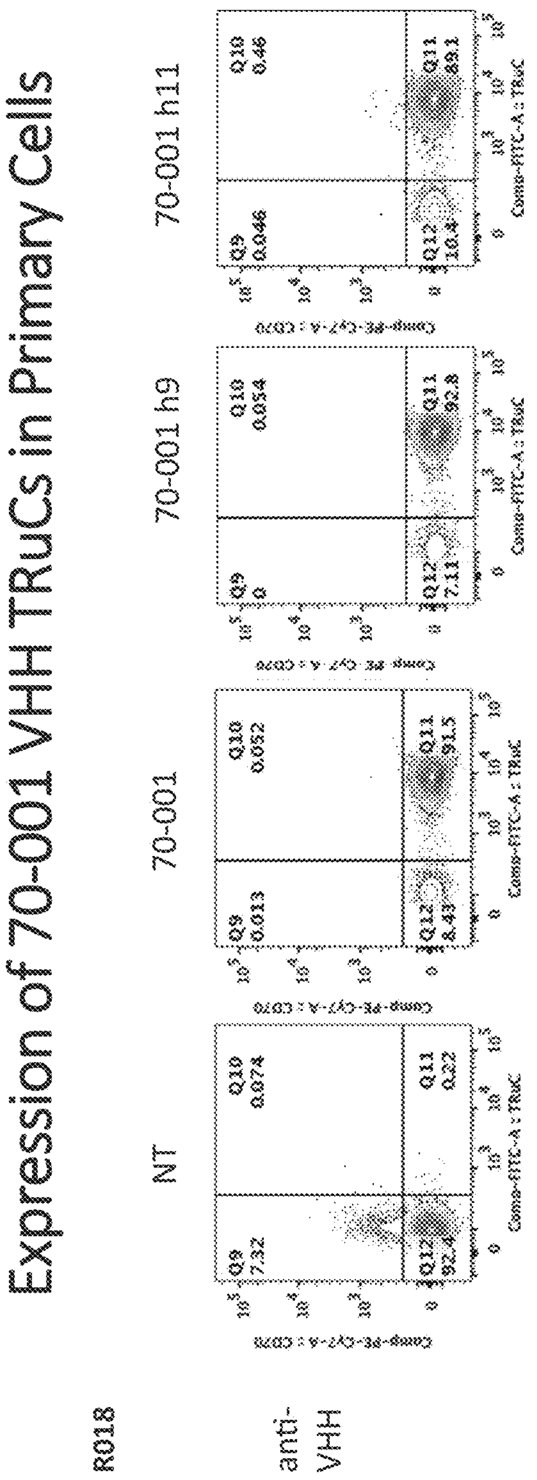
FIG. 58 is series of plots showing transduction efficiency as determined by detection of VHH expression in T cells from one representative donor transduced with the CD70 TFPs having the humanized VHH binders shown, 70-001 CD70 TFP (P3E8), or untransduced controls.

Following expansion, transduction efficiency was assessed by flow cytometry. For TFPs having binders 70-001, h7, h8, h9, C02, F07-6, and TC-110, assessment of transduction efficiency by flow cytometric detection of anti-CD70 binder surface expression using Fc-CD70 protein is shown in FIG. 51. Cells expressing TFPs having all humanized binders showed strong transduction efficiency, while transduction efficiency was weaker for human scFv binders C02 and F07-6. For TFPs having binders 70-001, h9, and hi 1, assessment of transduction efficiency by flow cytometric detection of anti-VHH antibody is shown in FIG. 58. Strong transduction efficiency was observed with all constructs.

Phenotyping of TFP T Cells

Figure 53A:
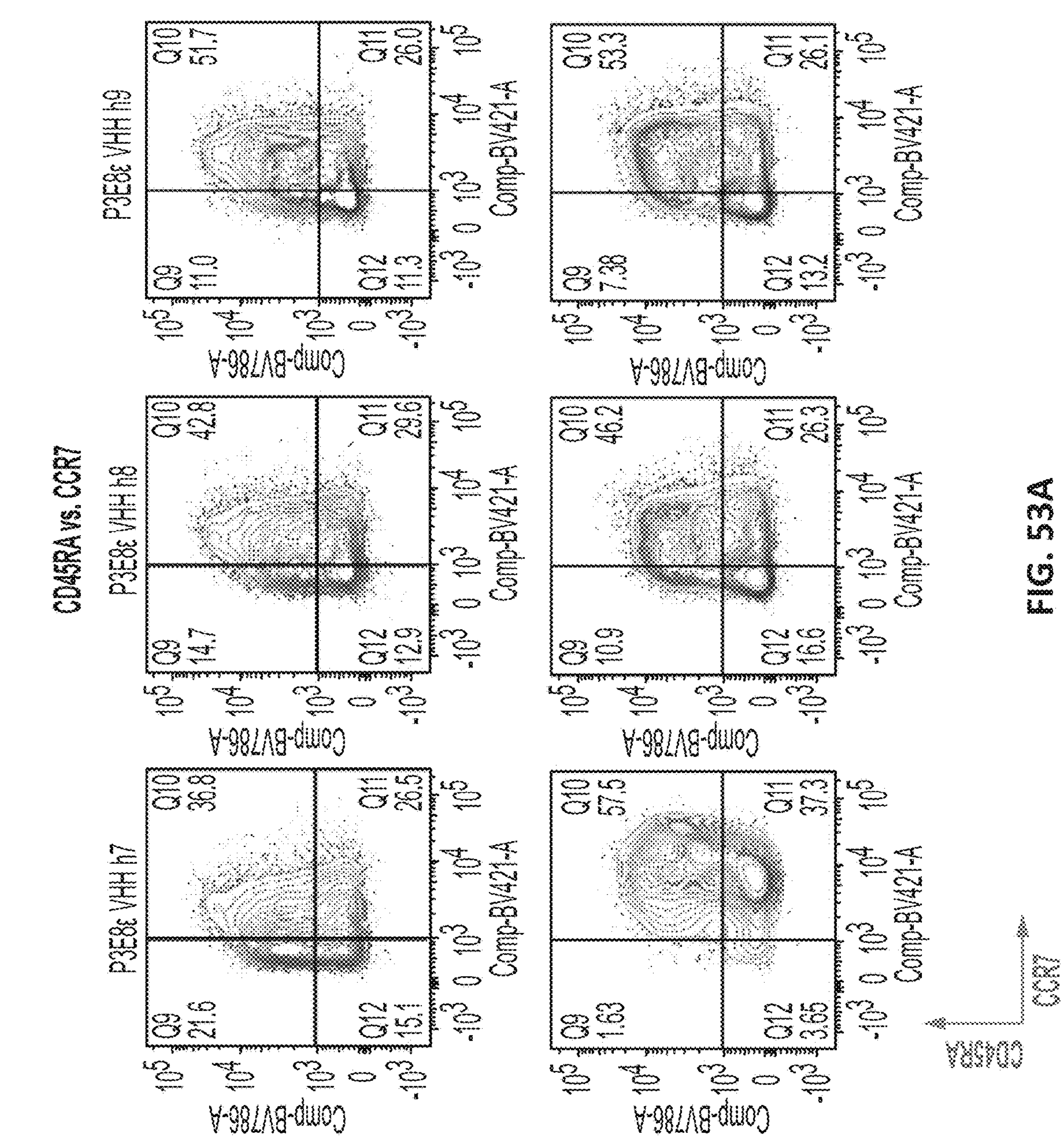
FIG. 53 is a series of plots showing memory phenotype as determined by flow cytometry detecting cell surface expression of CD45RA and CD27 in T cells from two donors transduced with the CD 70 TFPs having scFv or humanized VHH binders shown, or 70-001 CD70 TFP (P3E8), TC-110, or untransduced controls.
Figure 53B:
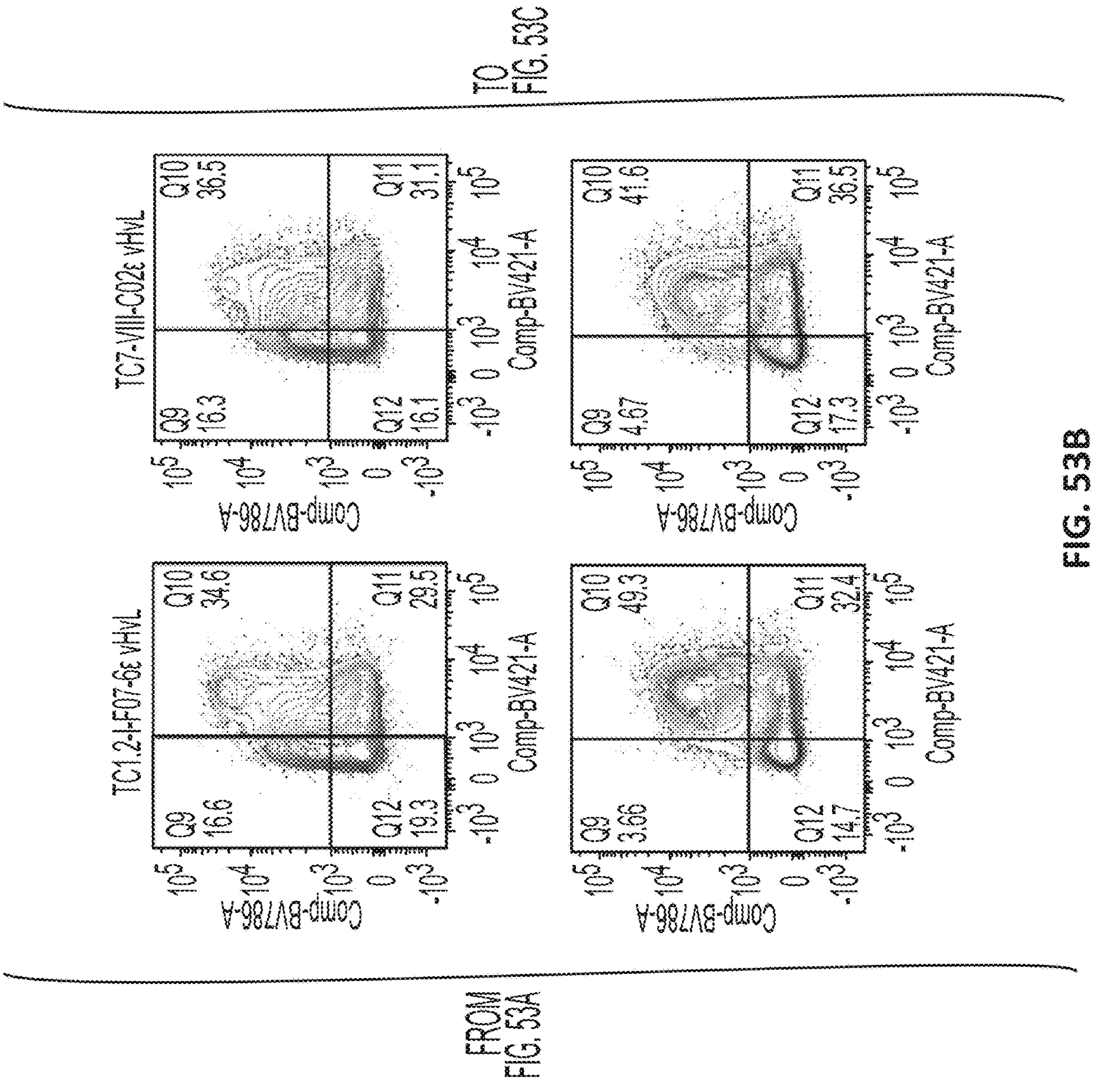
Figure 53C:
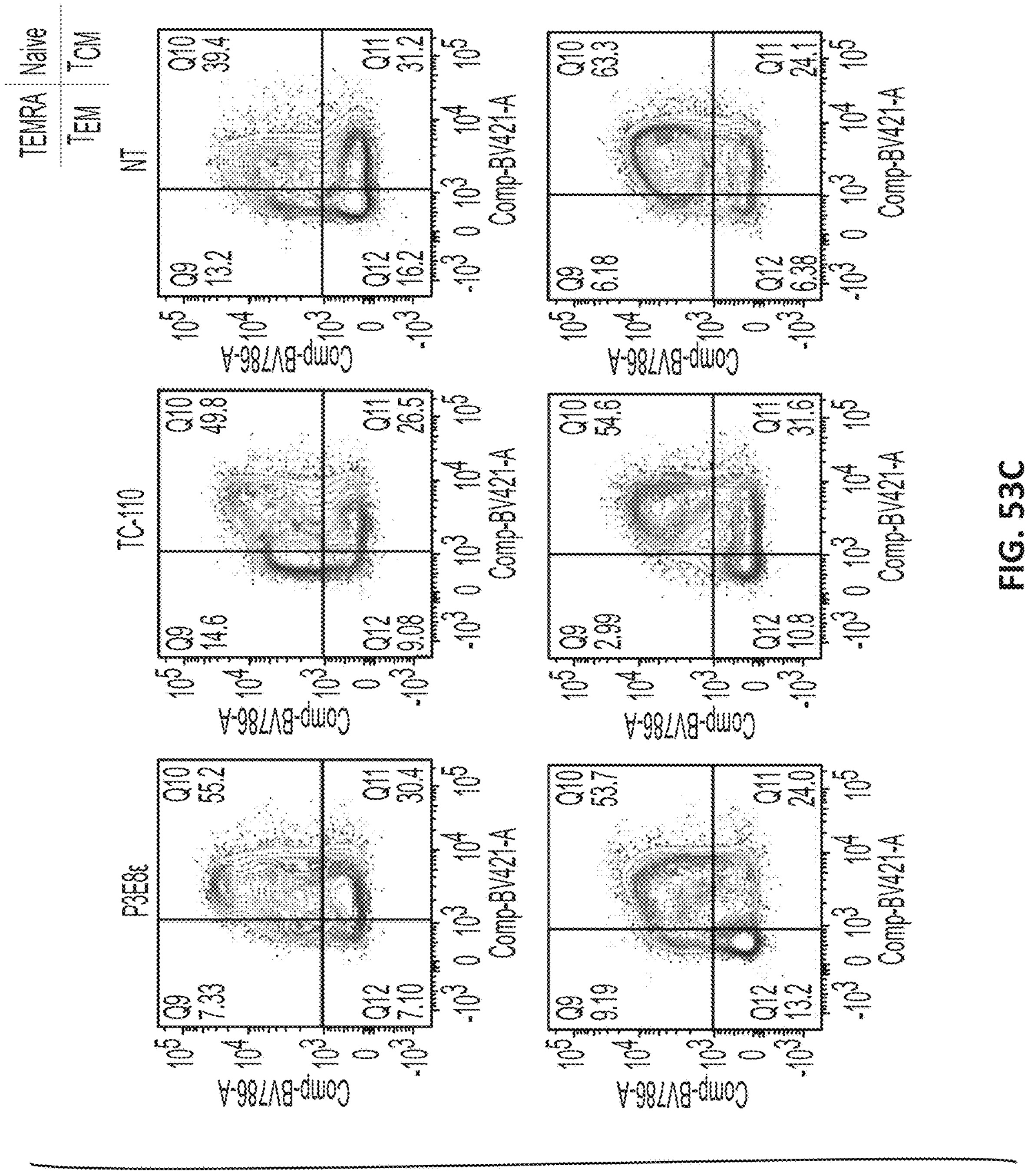
Figure 54A:
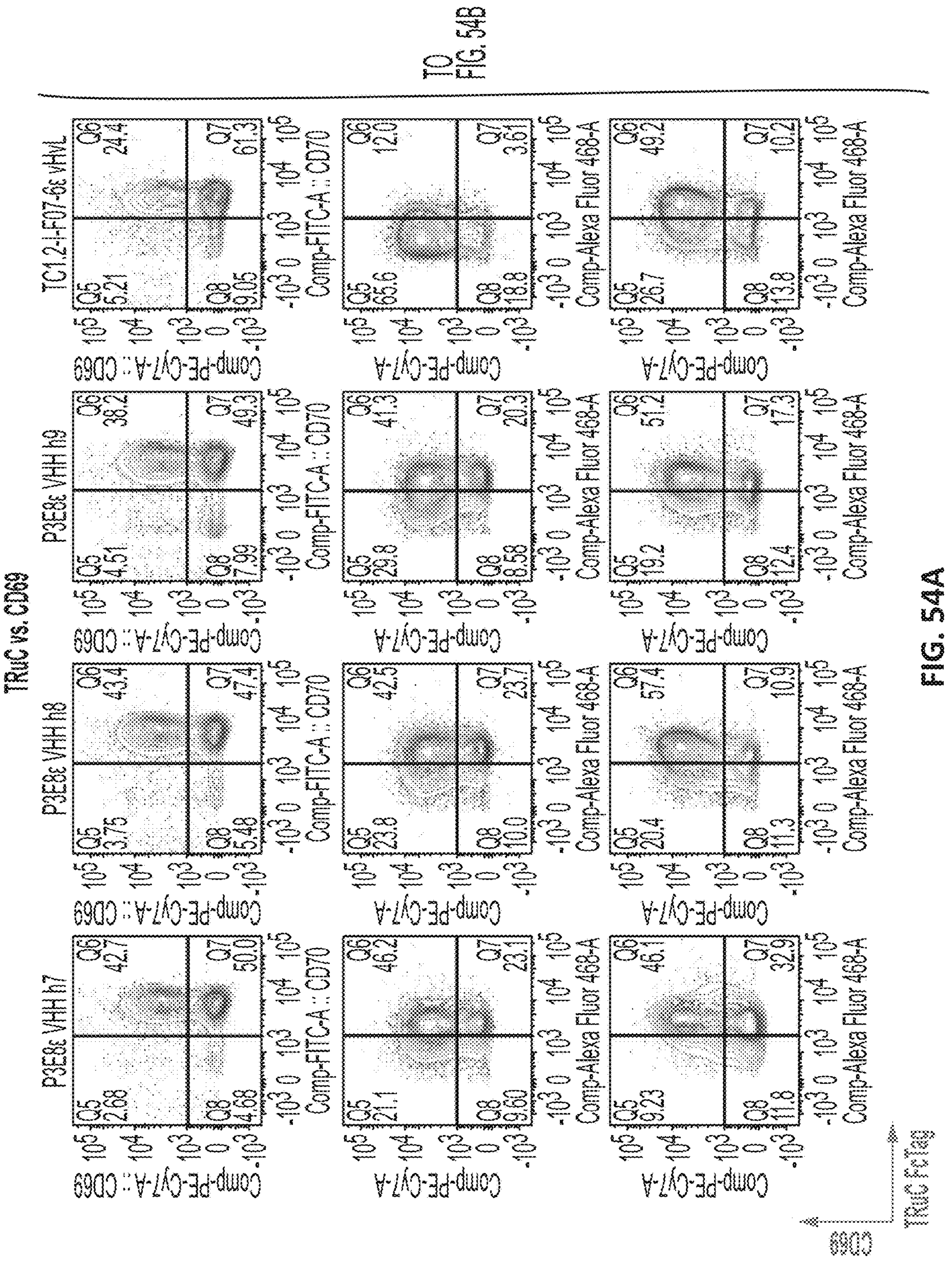
FIG. 54 is a series of plots showing flow cytometry data detecting cell surface expression of CD69 in T cells from three donors transduced with the CD 70 TFPs having scFv or humanized VHH binders shown, or 70-001 CD70 TFP (P3E8), TC-110, or untransduced controls.
Figure 54B:
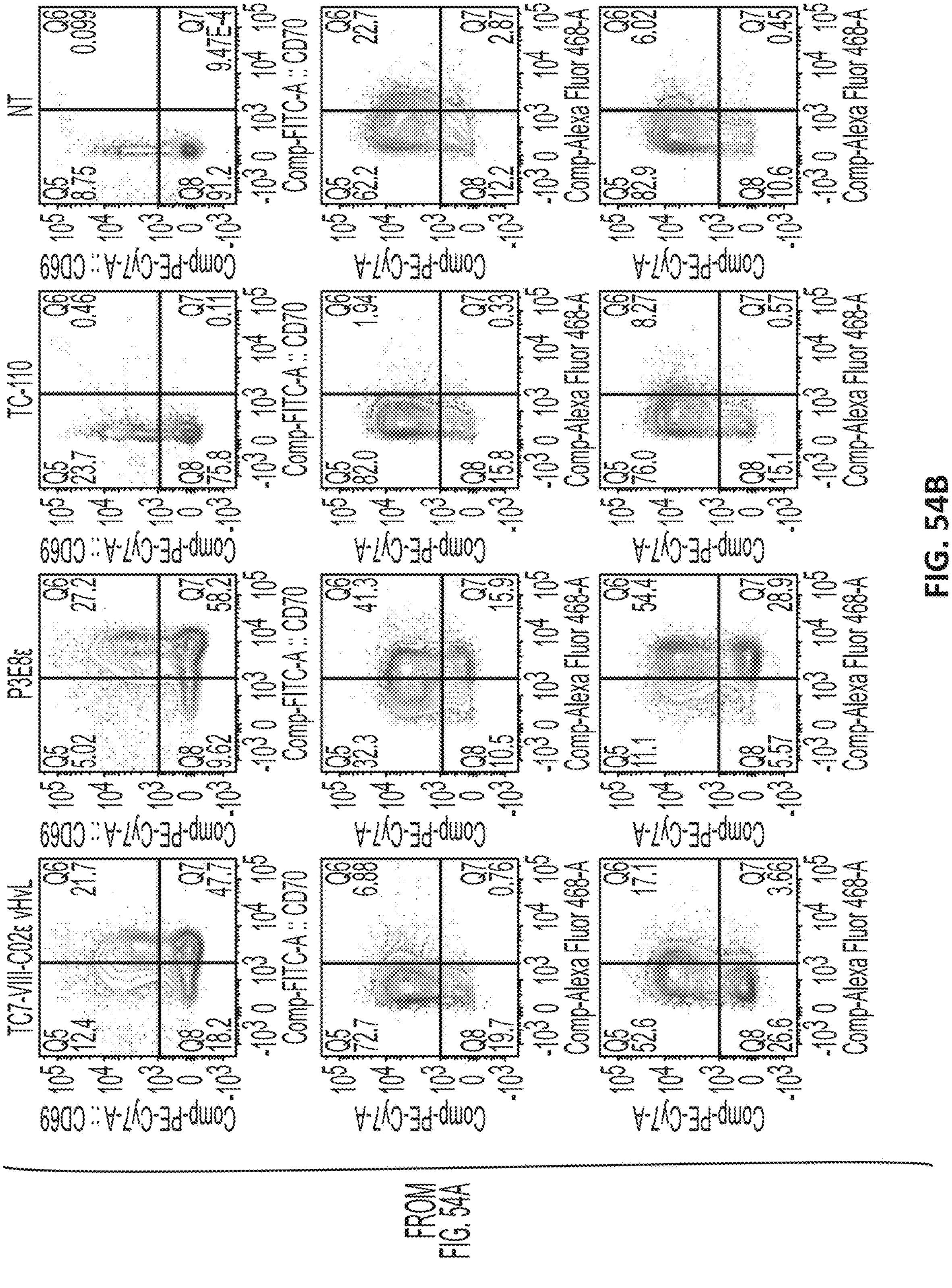
Figure 59:
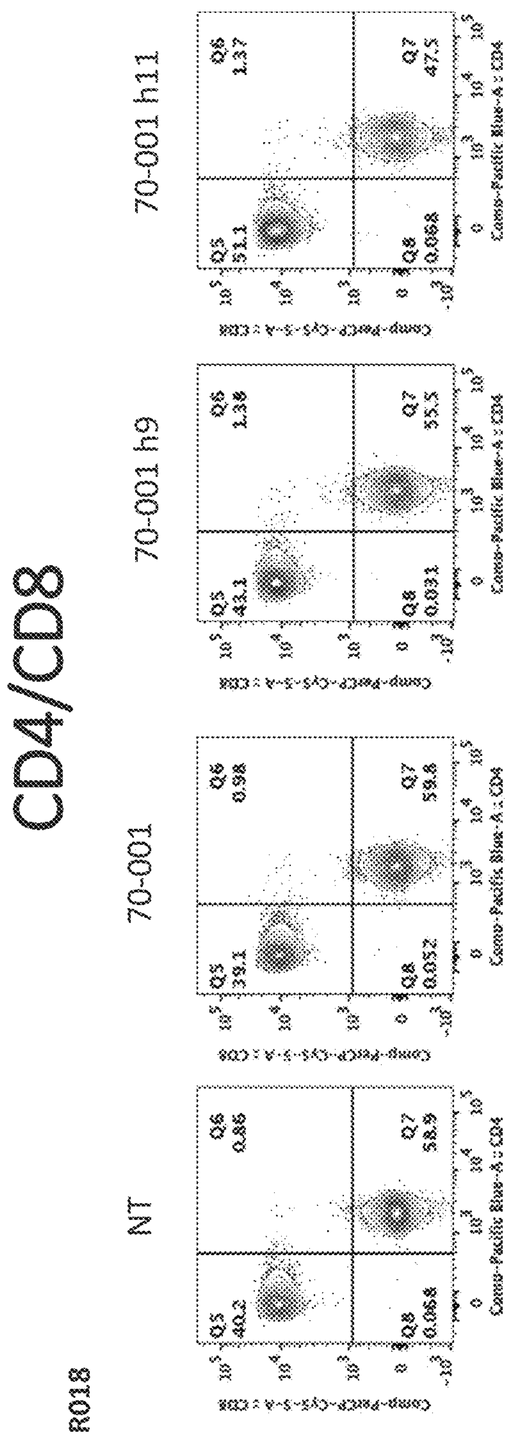
FIG. 59 is a series of plots showing flow cytometry data detecting CD4+ and CD8+ positivity in T cells from one representative donor transduced with the CD70 TFPs having the humanized VHH binders shown, 70-001 CD70 TFP (P3E8), or untransduced controls.
Figure 60A:
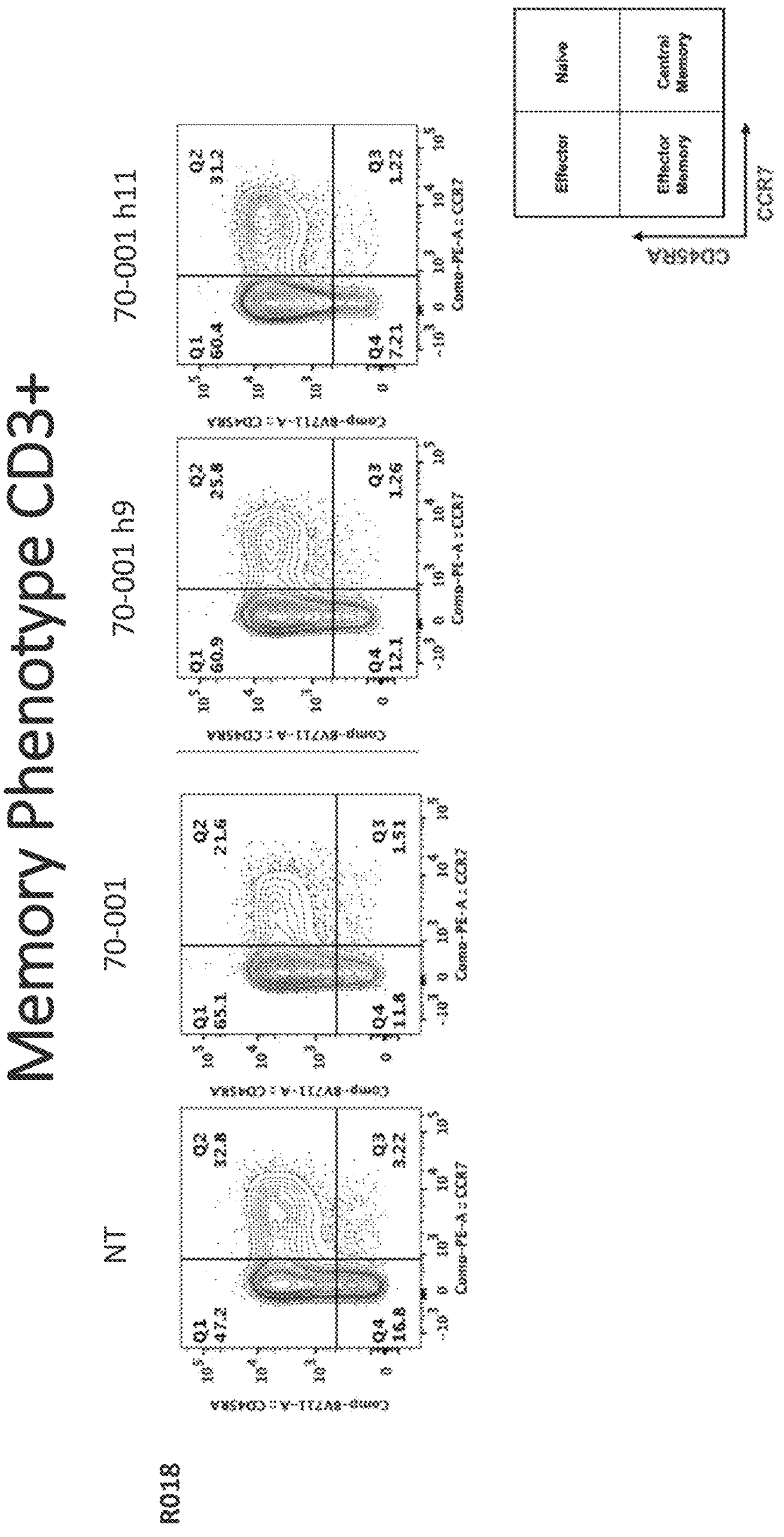
FIGS. 60A-60C are a series of plots showing memory phenotype as determined by flow cytometry detecting cell surface expression of CD45RA and CD27 in T cells from one representative donor transduced with the CD70 TFPs having the humanized VHH binders shown, 70-001 CD70 TFP (P3E8), untransduced controls.
Figure 60B:
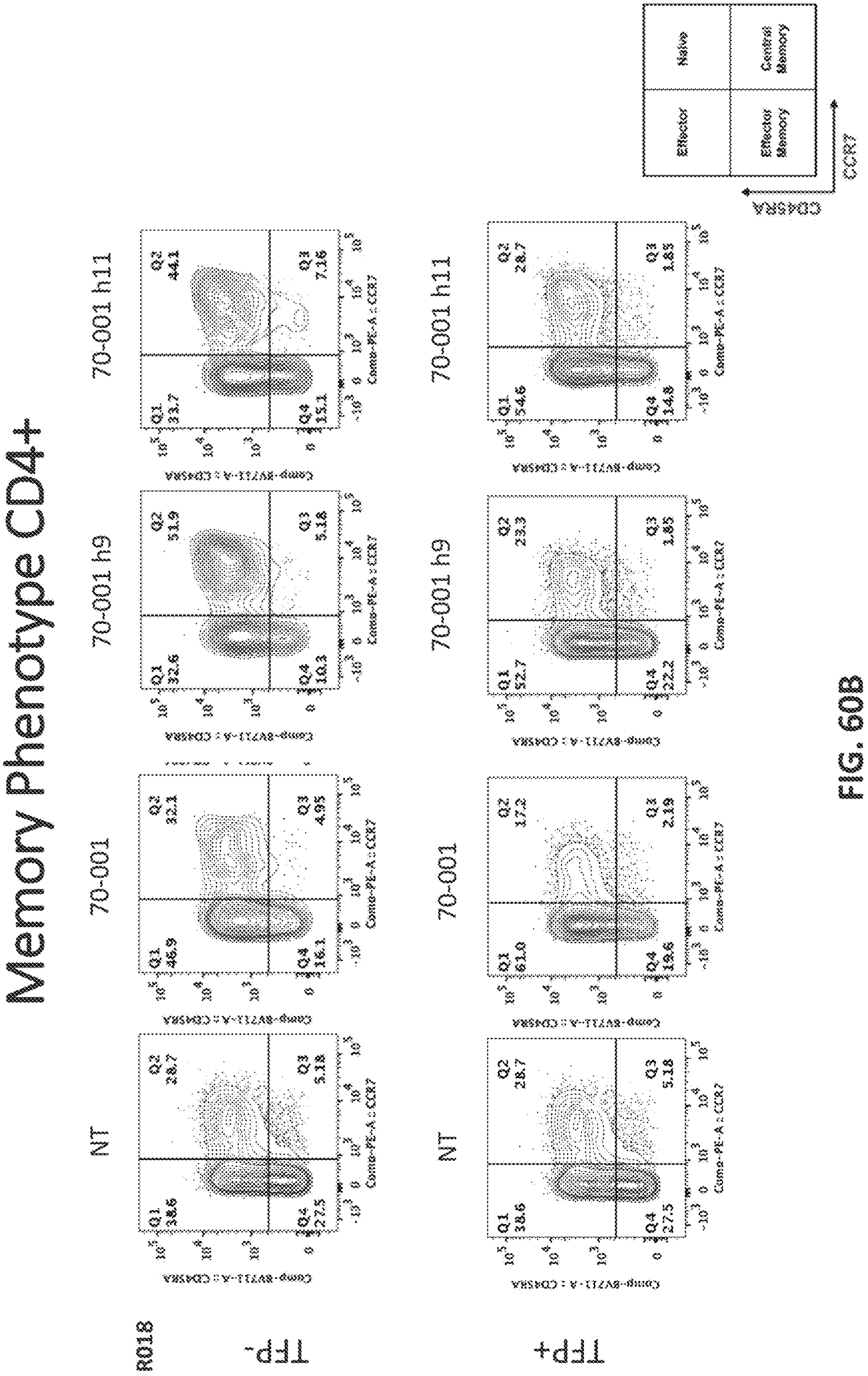
Figure 60C:
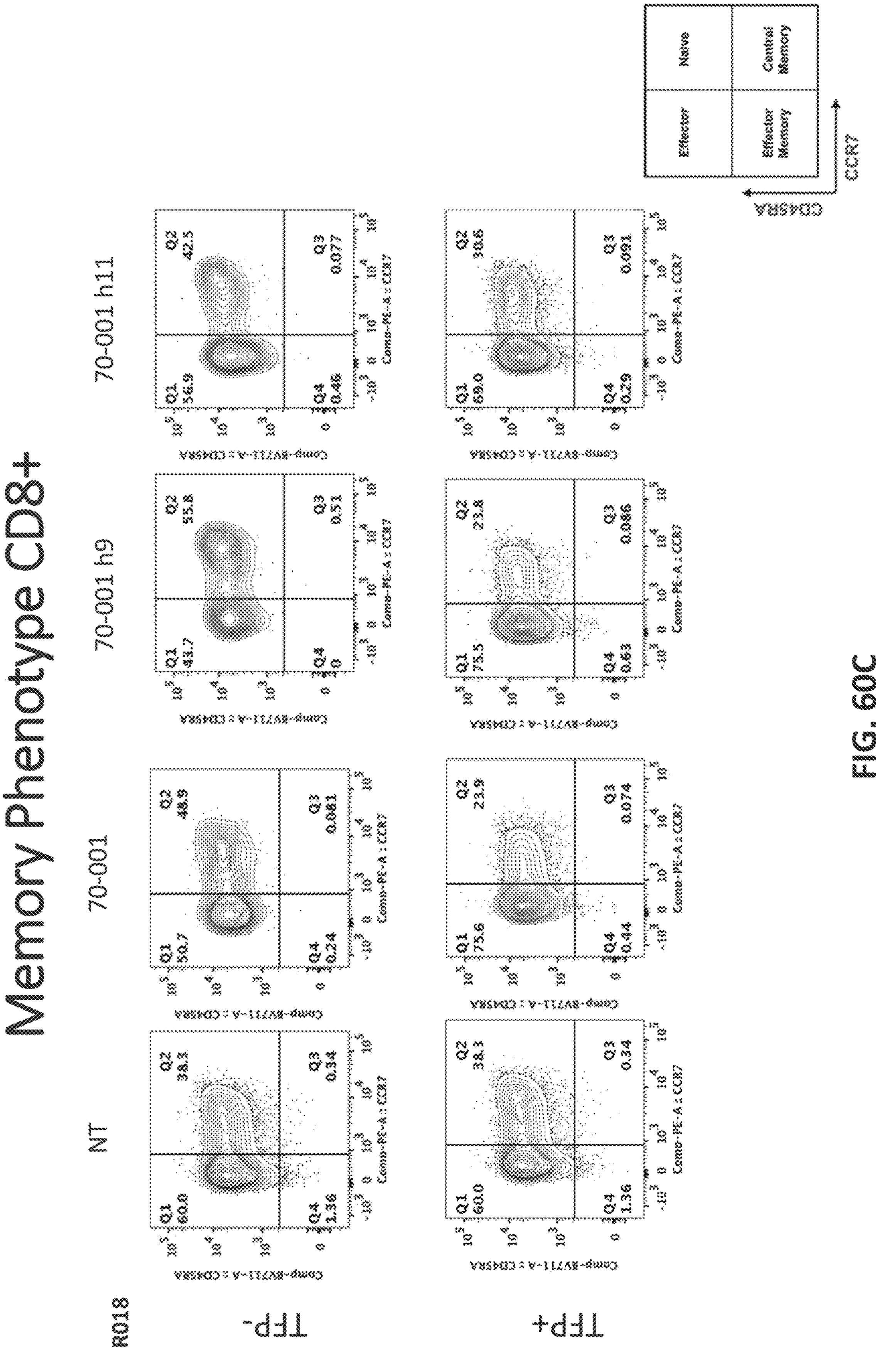

At day 10 of expansion, T cells were harvested and the cells were characterized by flow cytometry. Detection of CD4+ and CD8+ T cells from three donors for T cells transduced with TFPs having binders 70-001, h7, h8, h9, C02, F07-6, TC-110, and nontransduced cells is shown in FIG. 52. Detection of CD4+ and CD8+ T cells from three donors for T cells transduced with TFPs having binders 70-001, h9, h11, and non-transduced cells is shown in FIG. 59. While the ratio of CD4+:CD8+ T cells differed between donors, there were no significant differences between constructs. T-cell differentiation was determined by surface expression of CD45RA and CCR7 (Naïve, CD45RA$^+$ CCR7$^+$; CM, CD45RA$^-$CCR7$^+$; EM, CD45RA$^-$CCR7$^+$; TEMRA, CD45RA$^+$CCR7$^-$). The results for T cells expressing TFPs having binders 70-001, h7, h8, h9, C02, F07-6, TC-110, and nontransduced cells for two donors is shown in FIG. 53. The results for T cells expressing TFPs having binders 70-001, h9, h11, and nontransduced cells for one representative donor for CD3+ T cells and for CD4+ T cells and CD8+ T cells is shown in FIG. 60. For binders 70-001, h7, h8, h9, C02, F07-6, and TC-110, cell surface expression of CD69 was also measured as a measure of cell activation in cells from three donors (FIG. 60).

Cytotoxicity and Cytokine Production of T Cells

CD70 TFP mediated activation of donor T cells expressing TFP constructs was assessed by assessment of cytotoxicity and cytokine production following co-culture with CD70-negative K562 cells, CD70-positive THP-1 AML cells, and CD70-positive ACHN cells, and CD70 positive 786-O cells. For TFPs having binders 70-001 and C10, T cells generated in the presence of the 41D12 anti-CD70 antibody, as described in Example 9, were also evaluated and CD70 positive MOLM13 target cells were also tested. THP-1, ACHN, and MOLM13 have moderate levels of expression whereas 786-O has high levels of CD70 expression.

Figure 55:
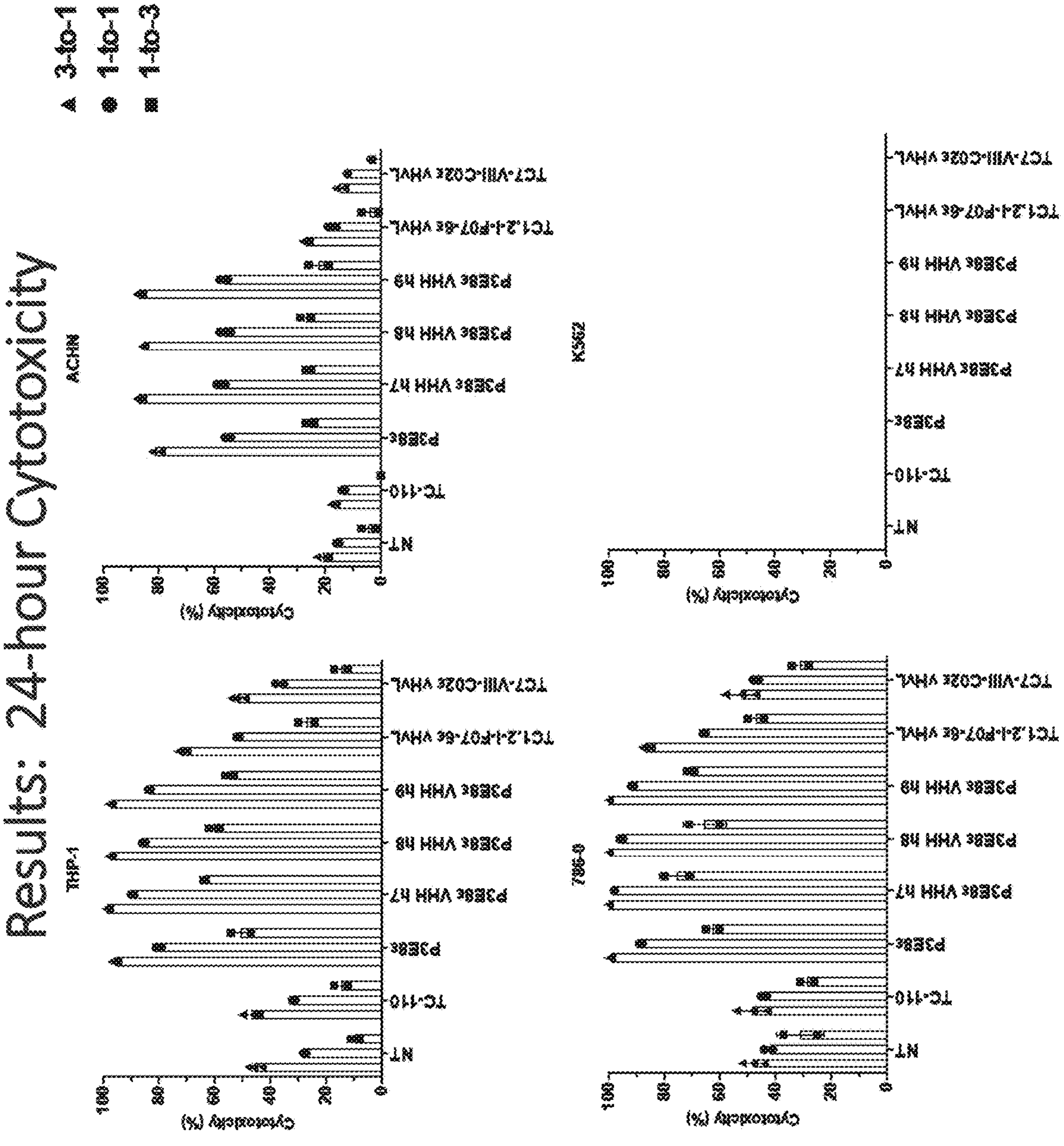
FIG. 55 series of graphs showing cytotoxicity of T cells transduced with TFPs having the binders shown or untransduced control T cells from one representative donor when co-cultured for 24 hours with THP-1, ACHN, 786-0, or K562 cells at a 3:1, 1:1, or 1:3 ratio.
Figure 61:
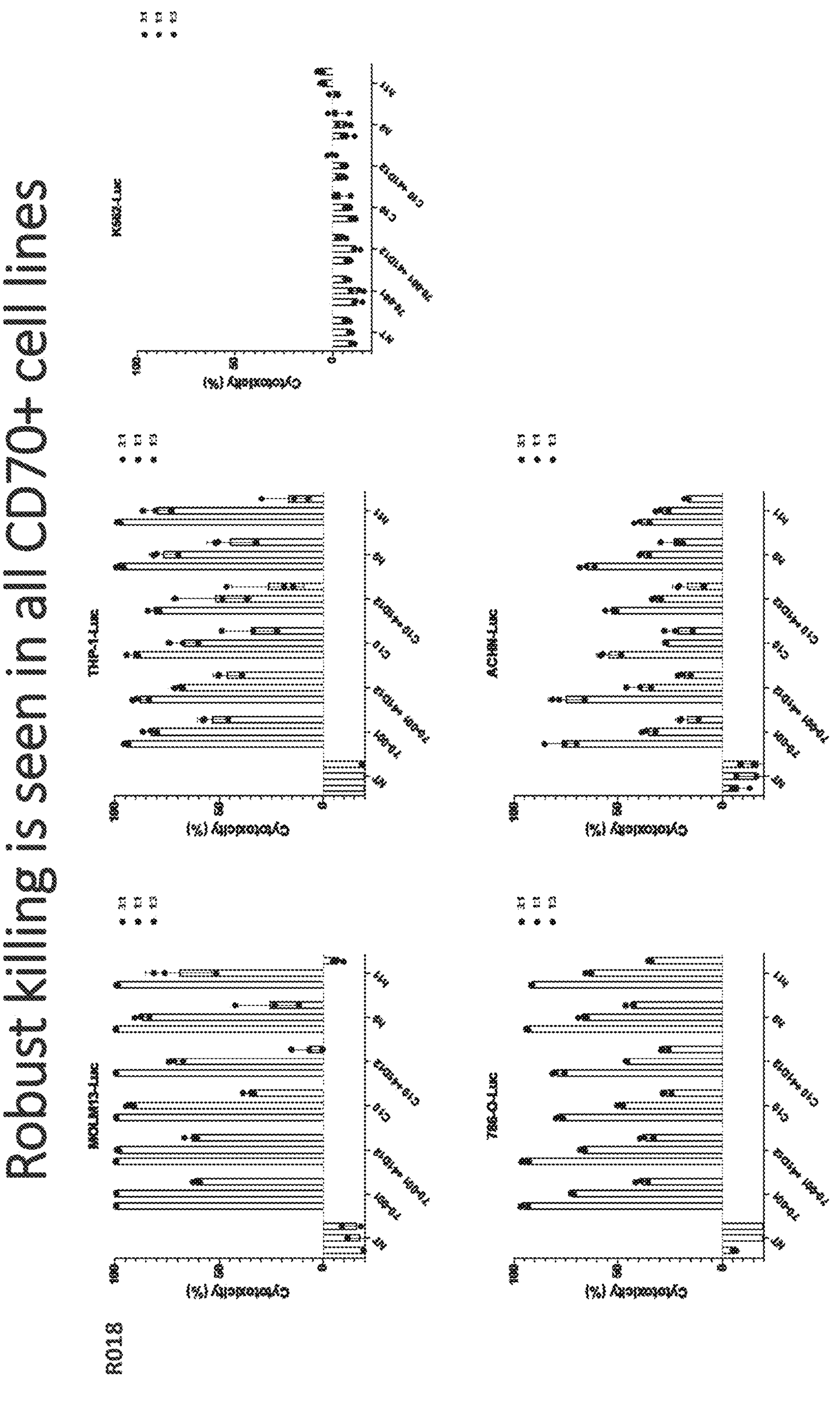
FIG. 61 is a series of graphs showing cytotoxicity of T cells transduced with TFPs having the binders shown, generated in the presence or absence of 41D12 antibody as indicated, or untransduced control T cells, from one representative donor, when co-cultured for 24 hours with THP-1, ACHN, 786-0, MOLM14, or K562 cells at a 3:1, 1:1, or 1:3 ratio.
Figure 62A:
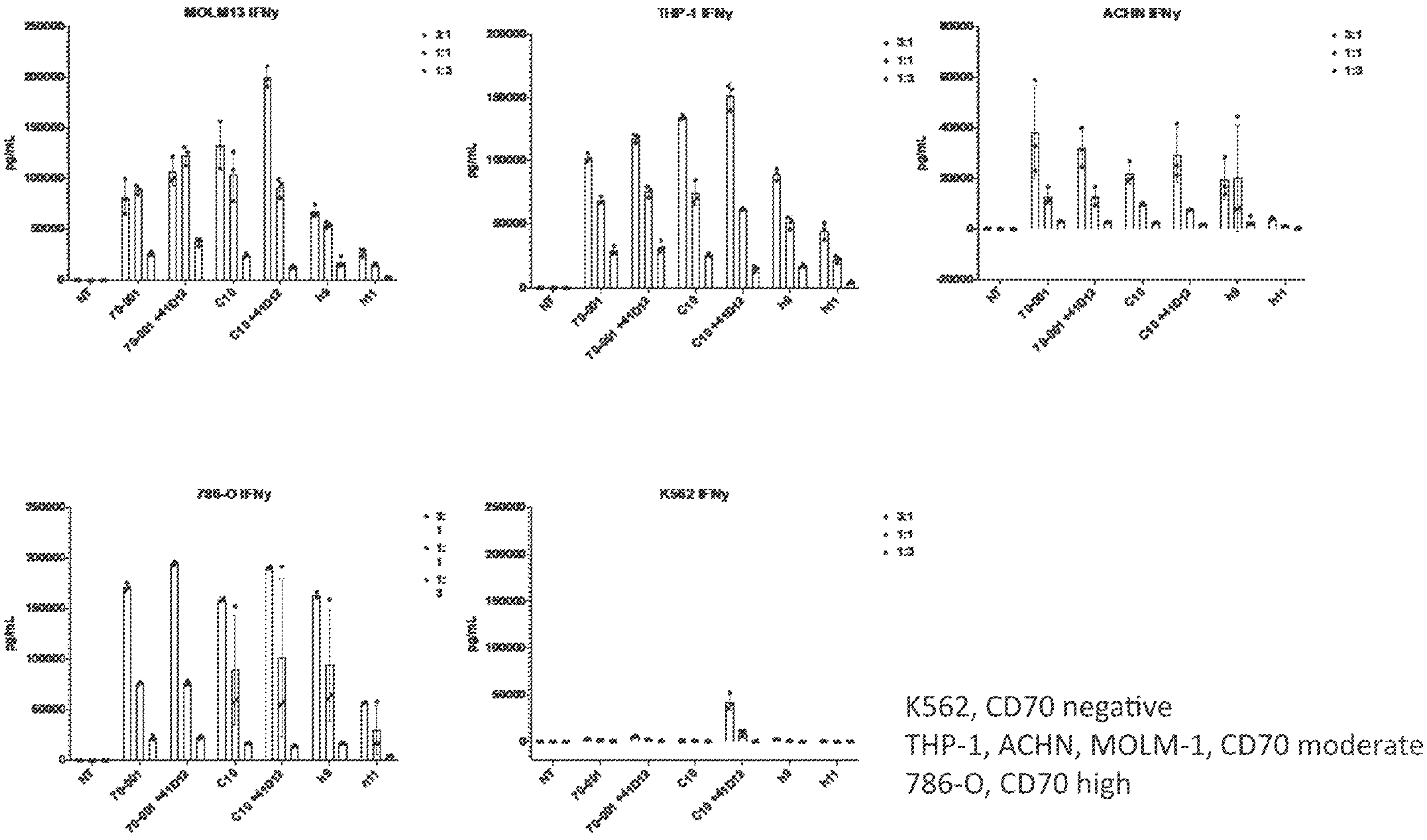
FIGS. 62A-62D are series of graphs showing cytokine production by T cells transduced with TFPs having the binders shown, generated in the presence or absence of 41D12 antibody as indicated, or untransduced control T cells from one representative donor when co-cultured for 24 hours with THP-1, ACHN, 786-0, MOLM13, or K562 cells at a 3:1, 1:1, or 1:3 ratio. IFN-γ (FIG. 62A), GM-CSF (FIG. 62B), IL-2 (FIG. 62C), and TNF-α (FIG. 62D) were measured.
Figure 62B:
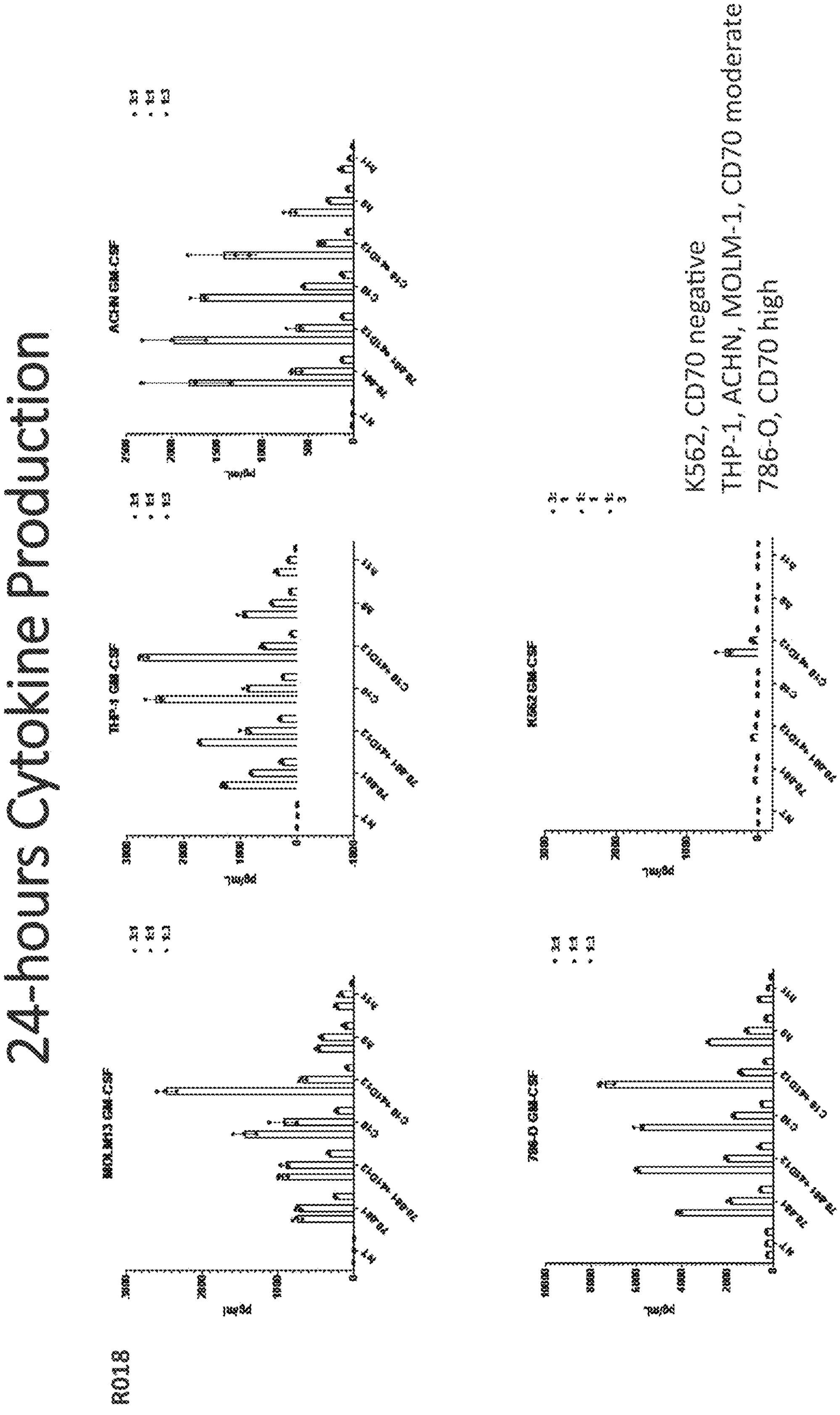
Figure 62C:
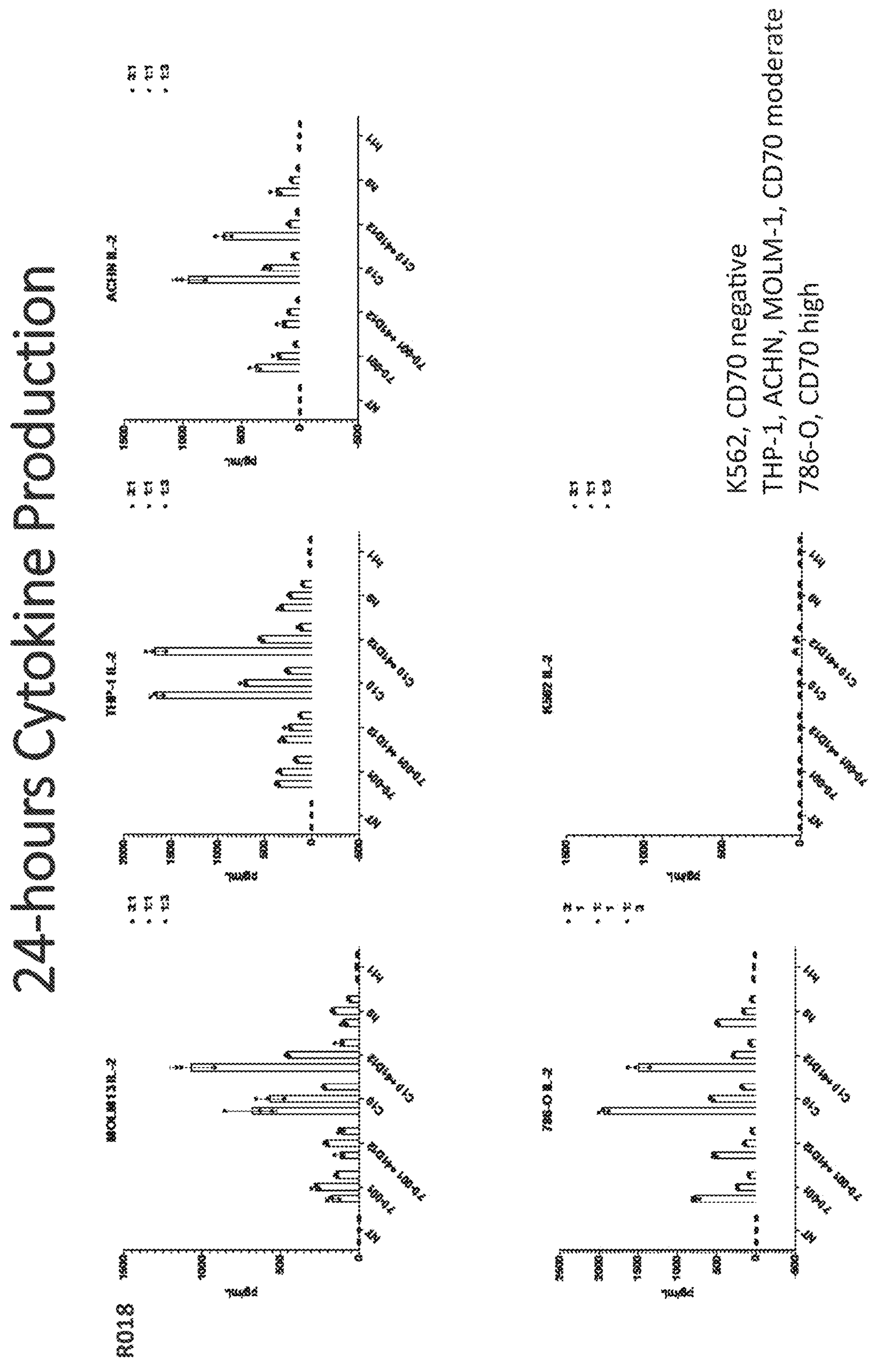
Figure 62D:
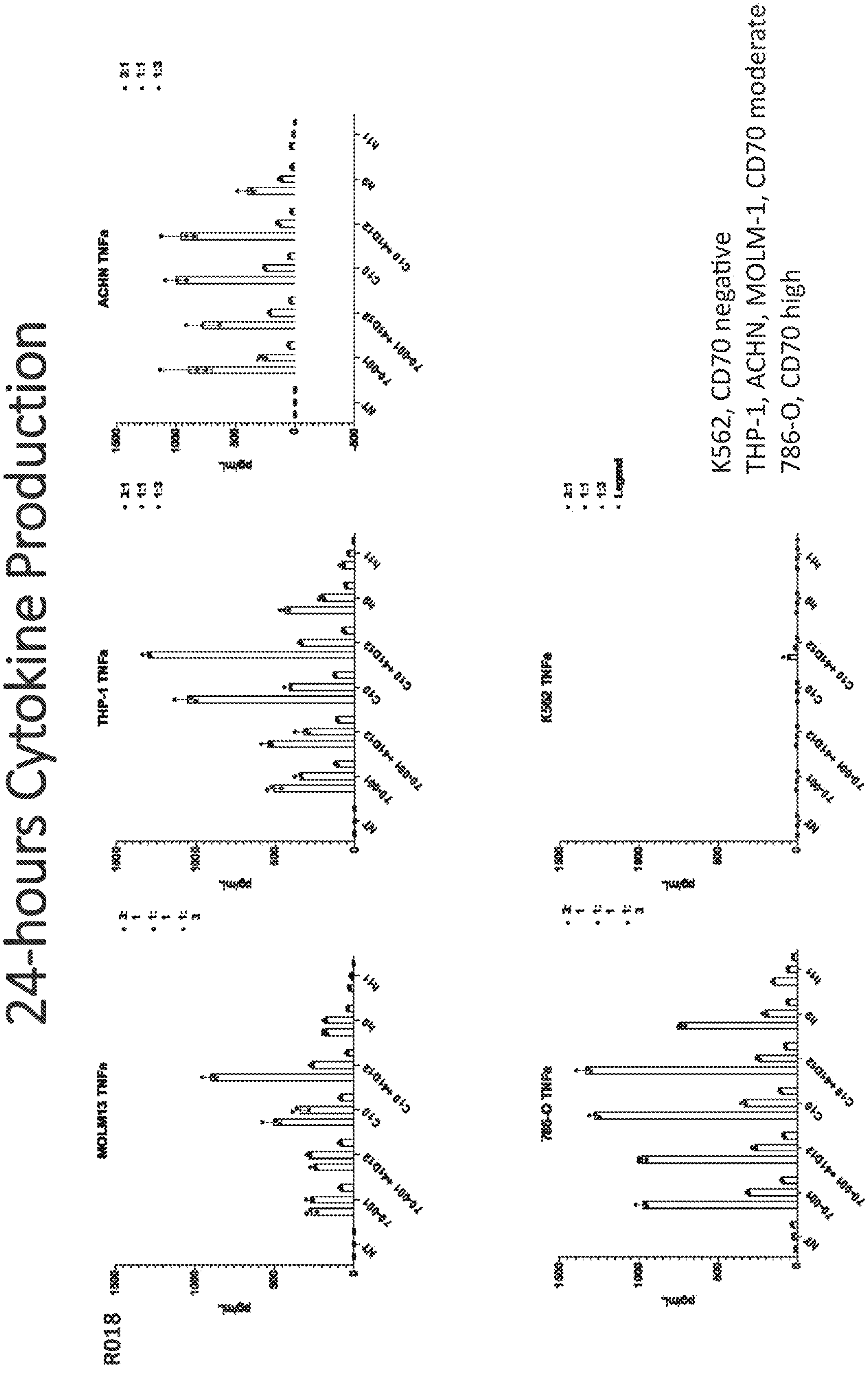

Cytotoxicity was measured as is described in Example 7. CD70 TFP expressing T cells or controls were co-cultured with luciferase expressing THP-1, ACHN, 786-0, MOLM13, or K562 cells at a 3:1, 1:1, or 1:3 ratio for 24 hours. The luciferase activity in live target cells was then measured and cytotoxicity calculated as described above. Data for one representative donor for T cells expressing TFPs having binders 70-001, h7, h8, h9, C02, F07-6, TC-110 or nontransduced controls is shown in FIG. 55. As is shown, T cells expressing 70-001 TFPs and each of the humanized CD70 TFPs (v7, v8, and v9) exhibited high levels of cytotoxicity towards CD70– expressing cells THP-1, ACHN, 786-O but not towards K562 cells, which do not express CD70. C02 and F07-6 TFP expressing T cells exhibited moderate cytotoxicity towards CD70 expressing target cells with F07-6 demonstrating higher cytotoxicity than C02. Data for one representative donor for T cells expressing TFPs having binders 70-001, h9, h11, and C10 generated in the in the absence of 41D12 antibody, for T cells having 70-001 or C10 TFPs generated in the presence of 41D12 antibody, and for nontransduced cells is shown in FIG. 61. All TFP expressing cells exhibited high cytotoxicity towards THP-1, ACHN, 786-0, and MOLM 13 CD70 expressing target cells, but not towards K562 cells, which do not express CD70.

Figure 56:
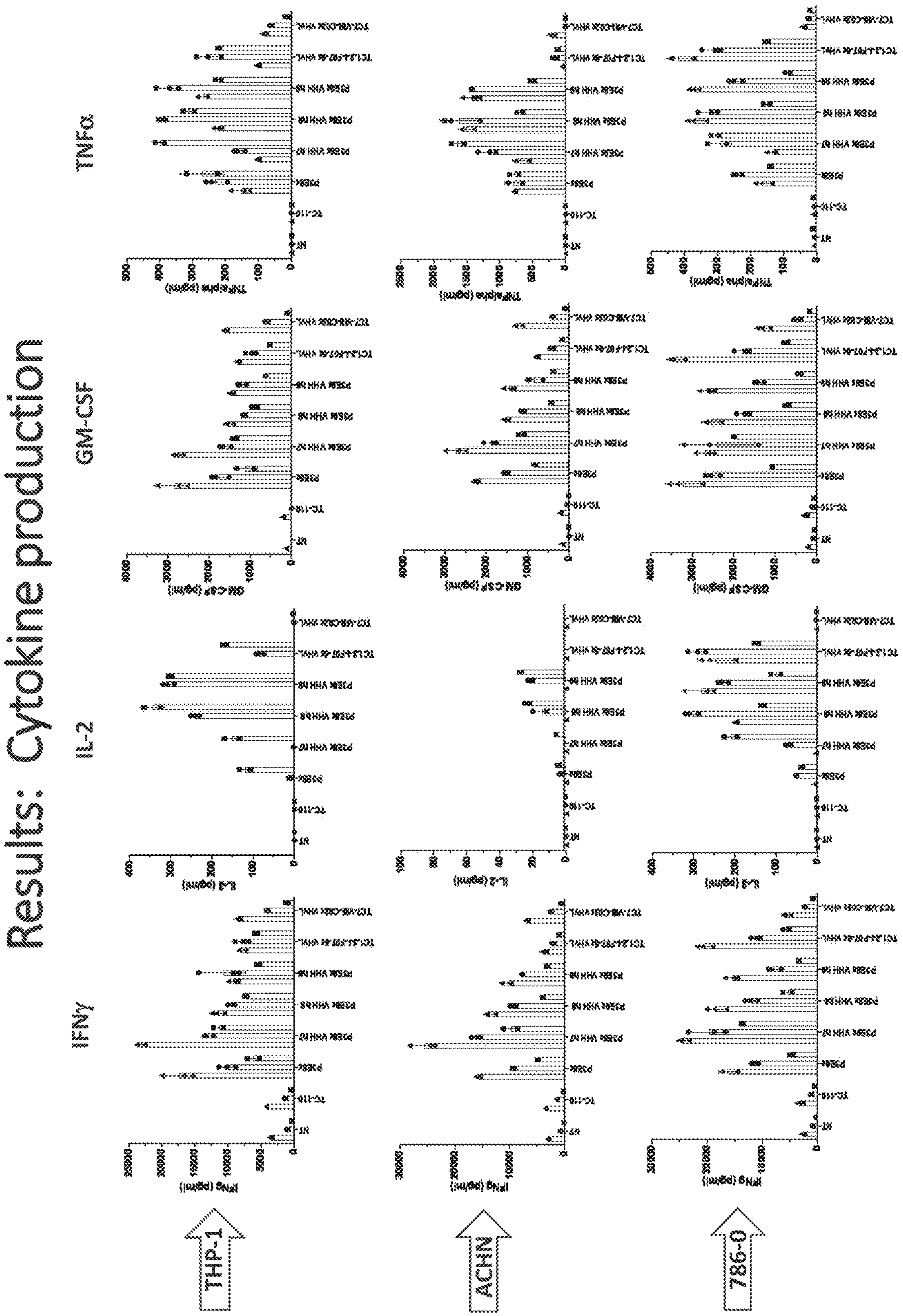
FIG. 56 a series of graphs showing cytokine production by T cells transduced with TFPs having the binders shown or untransduced control T cells from one representative donor when co-cultured for 24 hours with THP-1, ACHN, 786-0, or K562 cells at a 3:1, 1:1, or 1:3 ratio. IFN-γ, IL-2, TNF-α, and GM-CSF were measured.

Cytokine production was also measured from the same co-culture experiment using the methods described in Example 8. Levels of IFN-γ, TNF-α, GM-CSF, and IL-2 were detected. Data for one representative donor for T cells expressing TFPs having binders 70-001, h7, h8, h9, C02, F07-6, TC-110 or nontransduced controls is shown in FIG. 56. As is shown, T cells expressing 70-001 TFPs and each of the humanized CD70 TFPs (h7, h8, and h9) exhibited high levels of cytokine production in response to co-culture with CD70-expressing cells THP-1, ACHN, 786-0, although the induction of IL-2 expression in response to co-culture with the ACHN cell line was moderate. C02 and F07-6 TFP expressing T cells exhibited moderate levels of cytokine production in response to co-culture with CD70 expressing target cells with F07-6 demonstrating higher levels of cytokine production than C02.

Data for one representative donor for T cells expressing TFPs having binders 70-001, h9, hi 1, or C10 generated in the absence of 41D12 antibody, for T cells having 70-001 or C10 TFPs generated in the presence of 41D12 antibody, and for nontransduced cells is shown in FIG. 62. The C10 TFP, generated in the presence or absence of the 41D12 antibody, exhibited the highest levels of cytokine production in response to co-culture with CD70-expressing cells THP-1, ACHN, 786-0, and MOLM13. T cells expressing TFPs having binders 70-001 (generated in the presence or absence of the 41D12 antibody), h9, and h11 also produced cytokines in response to co-culture with CD70– expressing cells THP-1, ACHN, 786-0, and MOLM13. Negligible cytokine was produced by any of the T cells in response to co-culture with K562 cells, which do not express CD70.

Example 18: Generation of CD70 TFPs with Additional Fusion Proteins

C10 CD70 scFv TFP T cells were engineered that further express a PD-1 CD28 fusion protein or a membrane bound IL15 (Il-15 fused to IL15Rα by a flexible linker). The TFP and PD-1 CD28 fusion protein or membrane bound IL-15 are expressed in the same open reading frame and separated from the TFP by a self cleaving peptide. For example, in some embodiments, the fusion protein comprises an amino acid sequence selected from SEQ ID NOs: 1233, 1236, 1240, and 1264. For another example, in some embodiments, the expression construct comprises a recombinant nucleic acid molecule encoding an amino acid sequence selected from SEQ ID NO: 1233, 1236, 1240, or 1264. For another example, in some embodiments, the fusion protein comprises an amino acid sequence selected from the sequences listed in Table 12. For another example, in some embodiments, the expression construct comprises a recombinant nucleic acid molecule encoding an amino acid sequence selected from the sequences listed in Table 12.

Figure 63:
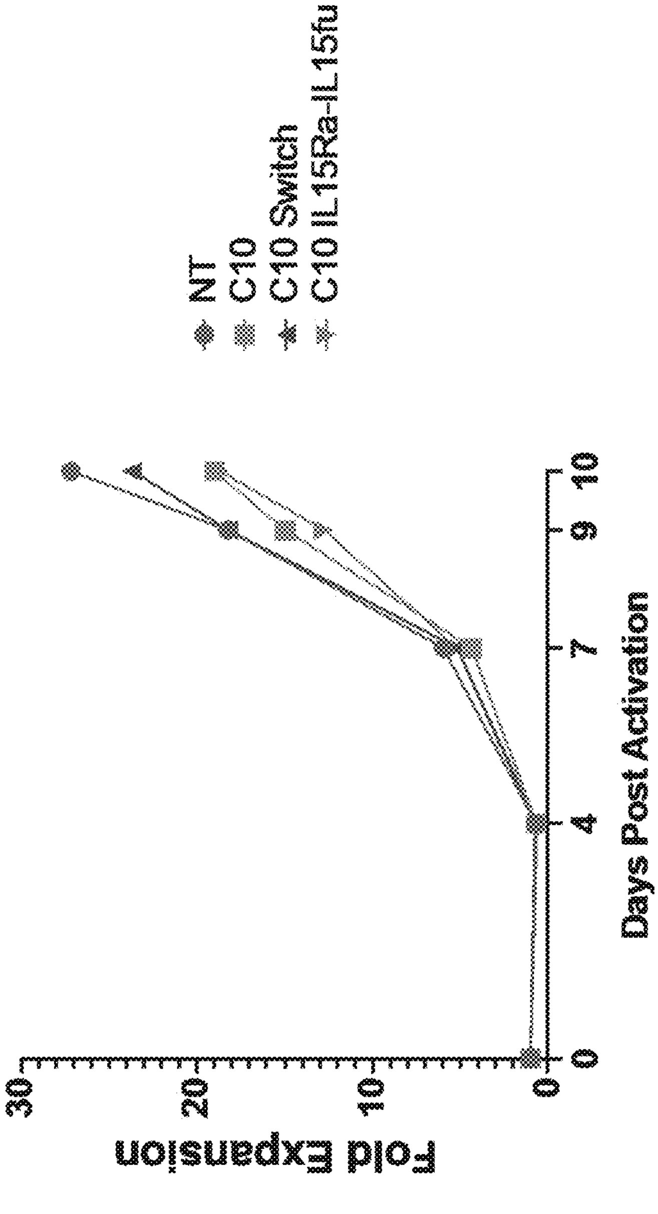
FIG. 63 is a graph showing expansion of T cells transduced with C10 CD 70 TFPs with or without the PD-1-CD28 fusion protein or membrane bound IL-15, or untransduced controls.

T cells were purified and transduced according to the methods described in Example 4. T cells having the TFPs indicated were activated and expanded with Human T cell TransAct (Miltenyi Biotech), with recombinant human IL-7 and IL-15, for 10 days. T cell expansion is shown in FIG. 63.

Verification of TFP Expression by Cell Staining

Figure 64:
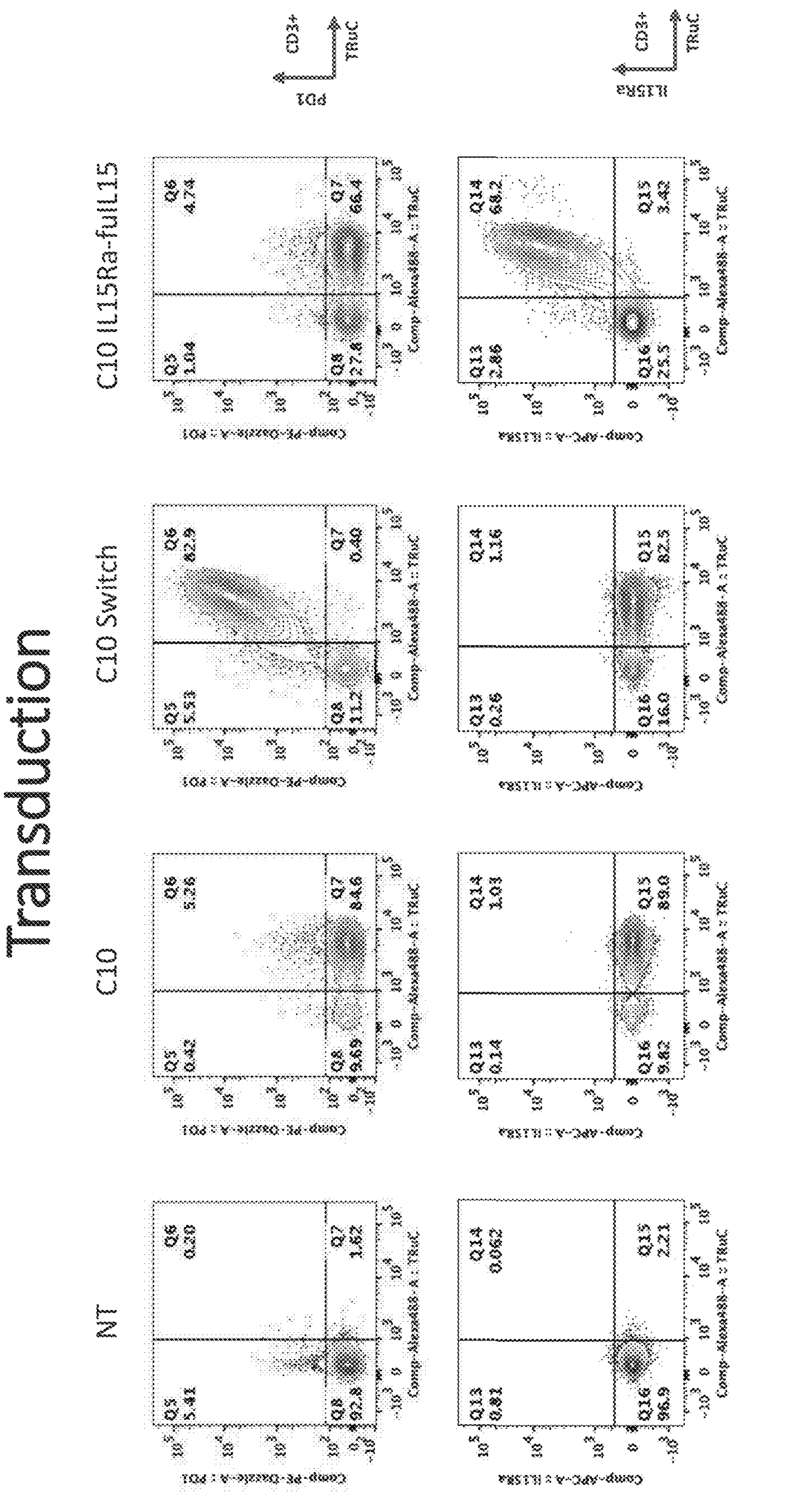
FIG. 64 is series of plots showing transduction efficiency (as determined by detection of VHH expression), cell surface PD-1 expression, and cell surface IL15Rα expression of T cells transduced with C10 CD70 TFPs with or without the PD-1-CD28 fusion protein or membrane bound IL-15, or untransduced controls.

At day 10 of expansion, T cells were harvested and the cells were characterized by flow cytometry. Transduction efficiency was assessed. Results are shown in FIG. 64. Surface expression of IL-15Ra and PD-1 was also measured. All constructs exhibited high transduction efficiency. PD-1 was detected on the surface of cells transfected with the C10 CD70 TFP and the PD-1 CD28 fusion protein. IL15Ra was detected on the surface of cells C10 CD70 TFP and the membrane bound IL15.

Phenotyping of TFP T Cells

Figure 65:
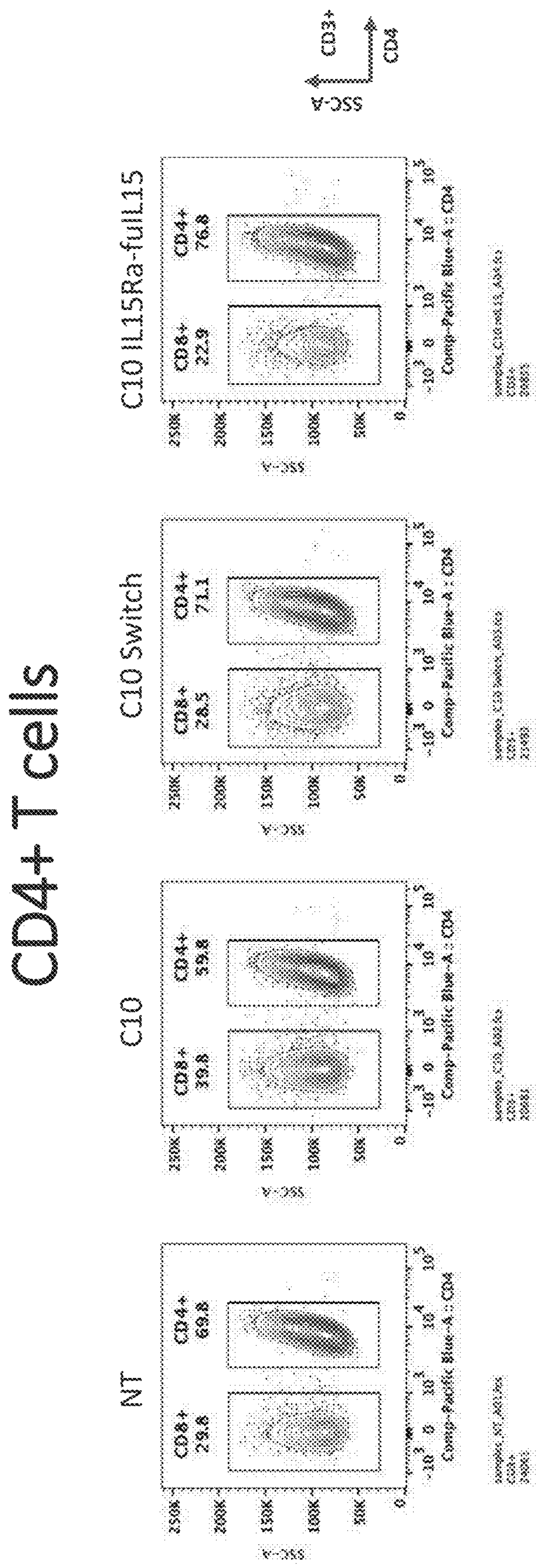
FIG. 65 is a series of plots showing flow cytometry data detecting CD4+ positivity in T cells transduced with C10 CD70 TFPs with or without the PD-1-CD28 fusion protein or membrane bound IL-15, or untransduced controls.
Figure 66:
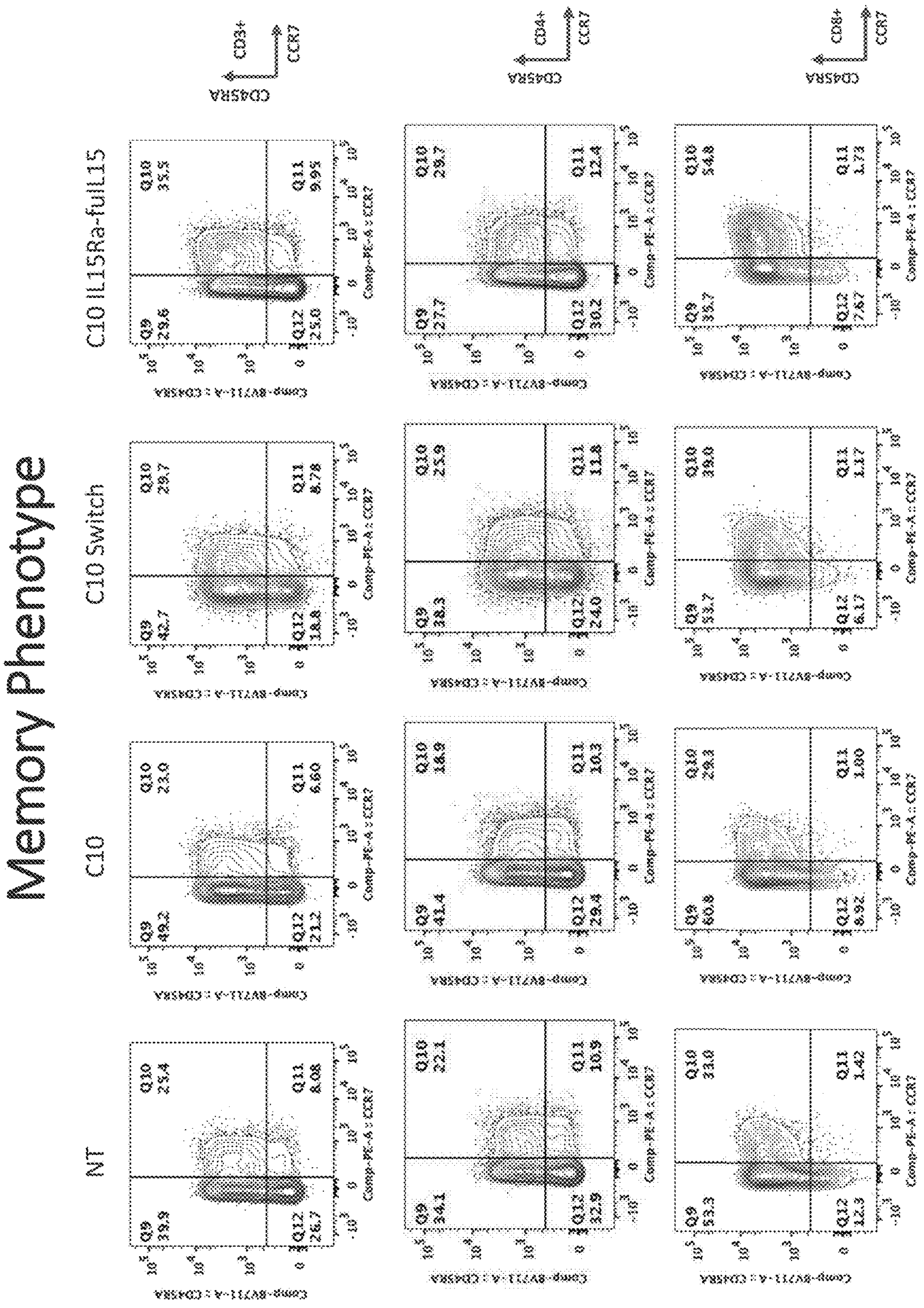
FIG. 66 is a series of plots showing memory phenotype as determined by flow cytometry detecting cell surface expression of CD45RA and CD27 in T cells transduced with C10 CD70 TFPs with or without the PD-1-CD28 fusion protein or membrane bound IL-15, or untransduced controls.

Detection of CD4+ T cells in cells transduced with the C10 TFP, with the C10 TFP with the PD-1 CD28 fusion protein, or with the C10 TFP with the membrane bound IL15 is shown in FIG. 65. T-cell differentiation was determined by surface expression of CD45RA and CCR7 (Naïve, $CD45RA^+CCR7^+$; CM, $CD45RA^-CCR7^+$; EM, $CD45RA^-CCR7^-$; TEMRA, $CD45RA^+CCR7^-$) in CD3+ T cells, CD4+ T cells, and CD8+ T cells. The results in FIG. 66 show that cells expressing the C10 TFP with the membrane bound IL15 show an increased proportion of naïve T cells relative to CD10 TFP expressing T cells.

Example 19: Generation of Additional Human scFv Anti-CD70 Antibodies

To generate additional human scFv anti-CD70 antibodies, alloy humanized mice were immunized with CD70. Titer-positive mice were selected for tissue harvest and hybridomas were generated. Antibodies produced by the hybridomas were screened for binding to CD70 expressing cell lines and for their ability to bind CD70 in the presence of CD27. Target cell binding is shown below in Table 3. Octet affinity data for CD70 is shown below in Table 4.

TABLE 3

Binding of alloy mouse generated CD70 antibodies to +/−CD70 cell lines

| Clone ID | JVM-3 | U266 | Raji | K562 |
|---|---|---|---|---|
| 13G6 | 479127 | 389366 | 144309 | 22536 |
| 9A11 | 409751 | 350647 | 145354 | 20160 |
| 9A1 | 401270 | 323782 | 139100 | 18525 |
| 11D12 | 353818 | 306554 | 125692 | 20555 |
| 8A2 | 341674 | 308824 | 123451 | 21799 |
| 4G7 | 322210 | 310389 | 102521 | 20538 |
| 6G10 | 303949 | 276010 | 83578 | 18366 |
| 15F8 | 234044 | 213098 | 85113 | 19117 |
| 1F6 | 224807 | 239393 | 68904 | 19006 |
| 1E3 | 120616 | 105681 | 38830 | 19242 |
| 9E4 | 89158 | 101943 | 43978 | 18818 |
| 8G10 | 87796 | 110928 | 22595 | 19114 |
| 6D7 | 81339 | 68485 | 28131 | 18723 |
| 13C1 | 80692 | 72601 | 32844 | 18075 |
| 13C9 | 73281 | 68926 | 27474 | 18737 |
| 12D1 | 72128 | 93313 | 32849 | 19215 |
| 1G12 | 68236 | 64672 | 23855 | 18271 |
| 6G3 | 67173 | 57329 | 25411 | 18128 |
| 2F1 | 31565 | 30551 | 12101 | 18079 |
| 6E6 | 27639 | 26373 | 24366 | 18845 |
| 3B6 | 27217 | 18532 | 12401 | 18840 |
| 1H7 | 26867 | 18714 | 13064 | 19269 |

TABLE 3-continued

Binding of alloy mouse generated CD70 antibodies to +/−CD70 cell lines

| Clone ID | JVM-3 | U266 | Raji | K562 |
| --- | --- | --- | --- | --- |
| 4C4 | 20560 | 17115 | 10242 | 18346 |
| 10G5 | 18895 | 23738 | 10704 | 17701 |
| 14A5 | 15315 | 15157 | 9178 | 19025 |
| 11G10 | 14091 | 12868 | 9201 | 18574 |
| 10E12 | 10663 | 10408 | 8212 | 18643 |
| 3B12 | 9841 | 8919 | 7877 | 18736 |
| 11G12 | 9584 | 9302 | 7690 | 18414 |
| 2B11 | 9299 | 8955 | 7546 | 18187 |
| 13G5 | 9186 | 8347 | 7886 | 21322 |
| 7A5 | 9184 | 8197 | 7960 | 18615 |
| 13C2 | 9141 | 8128 | 8289 | 18607 |
| 8G6 | 8966 | 8554 | 8067 | 19580 |
| 9B2 | 8936 | 8045 | 7312 | 18770 |
| 1F12 | 8900 | 7973 | 7780 | 19431 |
| 15C10 | 8794 | 8127 | 8189 | 18115 |
| 15A11 | 8698 | 7576 | 7800 | 18365 |
| 14G6 | 8683 | 7733 | 7944 | 18234 |
| 14C1 | 8487 | 7519 | 8073 | 18523 |
| 15D1 | 8454 | 7795 | 7000 | 17511 |
| 14C9 | 8244 | 7407 | 7719 | 18210 |
| 1A8 | 7992 | 7561 | 7323 | 16845 |

TABLE 4

Octet binding data for alloy mouse generated CD70 antibodies

| Clone ID | *IgG Conc. (μg/ml) | CD27:CD70 Interaction Neutralization of mAb Binding** | CD70 (100 nM) Response | KD (M) | ka (1/Ms) | kdis (1/s) | R^2 |
| --- | --- | --- | --- | --- | --- | --- | --- |
| 11D12 | 37.9 | 0.0506 | 0.4464 | 3.74E−12 | 8.03E+04 | 3.01E−07 | 0.999 |
| 13G6 | 27.1 | 0.0585 | 0.4092 | 3.42E−12 | 9.64E+04 | 3.30E−07 | 0.998 |
| 9A11 (9A11E8) | 34.7 | 0.0777 | 0.4286 | 2.46E−12 | 1.37E+05 | 3.36E−07 | 0.9951 |
| 15F8 (15F8D8) | 19.9 | 0.0349 | 0.3823 | 4.81E−12 | 6.98E+04 | 3.36E−07 | 0.9913 |
| 4C4 | Too Low | N.D. | 0.0239 | 3.72E−12 | 9.17E+04 | 3.41E−07 | 0.8453 |
| 8G10 | Too Low | N.D. | 0.0986 | 3.90E−12 | 9.52E+04 | 3.71E−07 | 0.9892 |
| 6D7 | 45.0 | 0.0729 | 0.3942 | 3.22E−12 | 1.16E+05 | 3.73E−07 | 0.9942 |
| 1G12 | 45.7 | 0.0788 | 0.4521 | 2.84E−12 | 1.32E+05 | 3.75E−07 | 0.9973 |
| 12D1 | 5.5 | 0.0198 | 0.3196 | 4.07E−12 | 9.24E+04 | 3.76E−07 | 0.9955 |
| 6E6 | 27.4 | 0.0582 | 0.4553 | 3.35E−12 | 1.15E+05 | 3.83E−07 | 0.9937 |
| 13C1 (13C1G6) | 42.6 | 0.0595 | 0.4155 | 5.00E−12 | 7.82E+04 | 3.91E−07 | 0.9976 |
| 6G3 | 31.5 | 0.0711 | 0.4166 | 3.24E−12 | 1.25E+05 | 4.06E−07 | 0.9964 |
| 1H7 | 50.1 | 0.0779 | 0.5111 | 2.93E−12 | 1.47E+05 | 4.31E−07 | 0.994 |
| 8A2 | 38.9 | 0.0562 | 0.5189 | 4.19E−12 | 1.05E+05 | 4.38E−07 | 0.9981 |
| 13C9 | 33.1 | 0.0548 | 0.4156 | 5.10E−12 | 9.05E+04 | 4.62E−07 | 0.9987 |
| 9E4 | 23.5 | 0.0363 | 0.4291 | 3.32E−12 | 1.47E+05 | 4.88E−07 | 0.9888 |
| 10G5 | Too Low | N.D. | 0.0183 | 4.29E−12 | 1.14E+05 | 4.88E−07 | 0.536 |
| 9A1 (9A1H6) | 36.0 | 0.0553 | 0.4337 | 6.03E−12 | 8.75E+04 | 5.28E−07 | 0.9992 |
| 1E3 (1E3D9) | 66.2 | 0.1019 | 0.5058 | 2.55E−10 | 1.52E+05 | 3.88E−05 | 0.9963 |
| m-anti-CD70 | 10.5 | 0.0124 | 0.4891 | 4.36E−10 | 9.37E+04 | 4.09E−05 | 0.9992 |
| 4G7 (4G7E8) | 16.3 | 0.0429 | 0.3573 | 1.28E−09 | 1.30E+05 | 1.67E−04 | 0.9972 |
| 2F1 (2F1F7) | 37.1 | 0.0275 | 0.6976 | 6.60E−09 | 8.41E+04 | 5.55E−04 | 0.9991 |
| 1F6 | Too Low | N.D. | N.B. | N.B. | N.B. | N.B. | N.B. |

*"Too Low" indicates concentrations of IgG in supernatant less than 3 μg/mL

**Value less than 0.04 indicates potential neutralization of mAb binding

Antibodies 9A11, 15F8, 13C1, 9A1, 1E3, 4G7, and 2F1 with high affinity for CD70 were cloned into scFv format in vLvH and vHvL orientation to generate scFv antibodies 15F8D8 VH VL, 15F8D9 VL VH, 9A11E8 VH VL, 9A11E8 VL VH, 9A1H6 VH VL, 9A1H6 VL VH, 4G7E8 VH VL, 4G7E8 VL VH, 2F1F7 VH VL, 2F1F7 VL VH, 1E3D9 VH VL, 1E3D9 VL VH, 13C1G6 VH VL1, 13C1G6 VL1 VH, 13C1G6 VH VL2, and 13C1G6 VL2 VH.

Example 20: Additional scFv TFP Constructs

Human scFv anti-CD70 TFP constructs were engineered by cloning the CD70 scFv DNA fragment linked to a CD3 or TCR DNA fragment by either a DNA sequence encoding a short linker (SL): AAAGGGGSGGGGSGGGGSLE (SEQ ID NO:692) or a long linker (LL): AAAIEVMYPPPYLGGGGSGGGGSGGGGSLE (SEQ ID NO:693) into a lentiviral vector. Various other vector may be used to generate fusion protein constructs. TCR subunits that can be used are described in Example 3 above. Examples of the anti-CD70 TFP constructs generated include anti-CD70-linker-human CD3P chain with the anti-CD70 antigen binding domain being 1E3D9 vHvL, 2F1F7 vLvH, 9A11E8 vLvH, 13C1G6 vLvH, 13G6E8 vLvH, or 15F8D8 vLvH.

Figure 67:
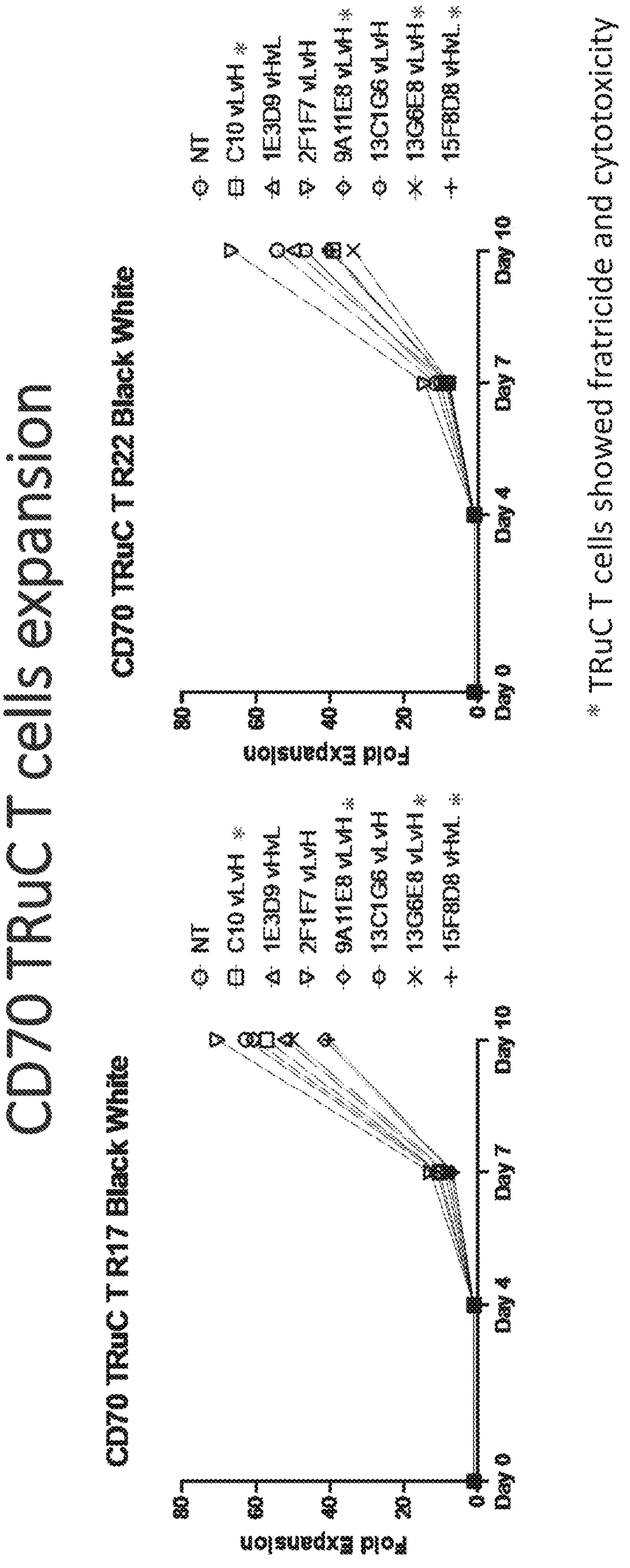
FIG. 67 is a series of graphs showing expansion of T cells from two donors transduced with the CD70 TFPs having human scFv binders shown or untransduced controls.

T cells from two donors were purified and transduced with the human scFv TFPs described above, or with the C10 TFP, according to the methods described in Example 4. T cells having the TFPs indicated were activated and expanded with Human T cell TransAct (Miltenyi Biotech), with recombinant human IL-7 and IL-15, for 10 days. T cell expansion is shown in FIG. 67.

Verification of TFP Expression by Cell Staining

Figure 68A:
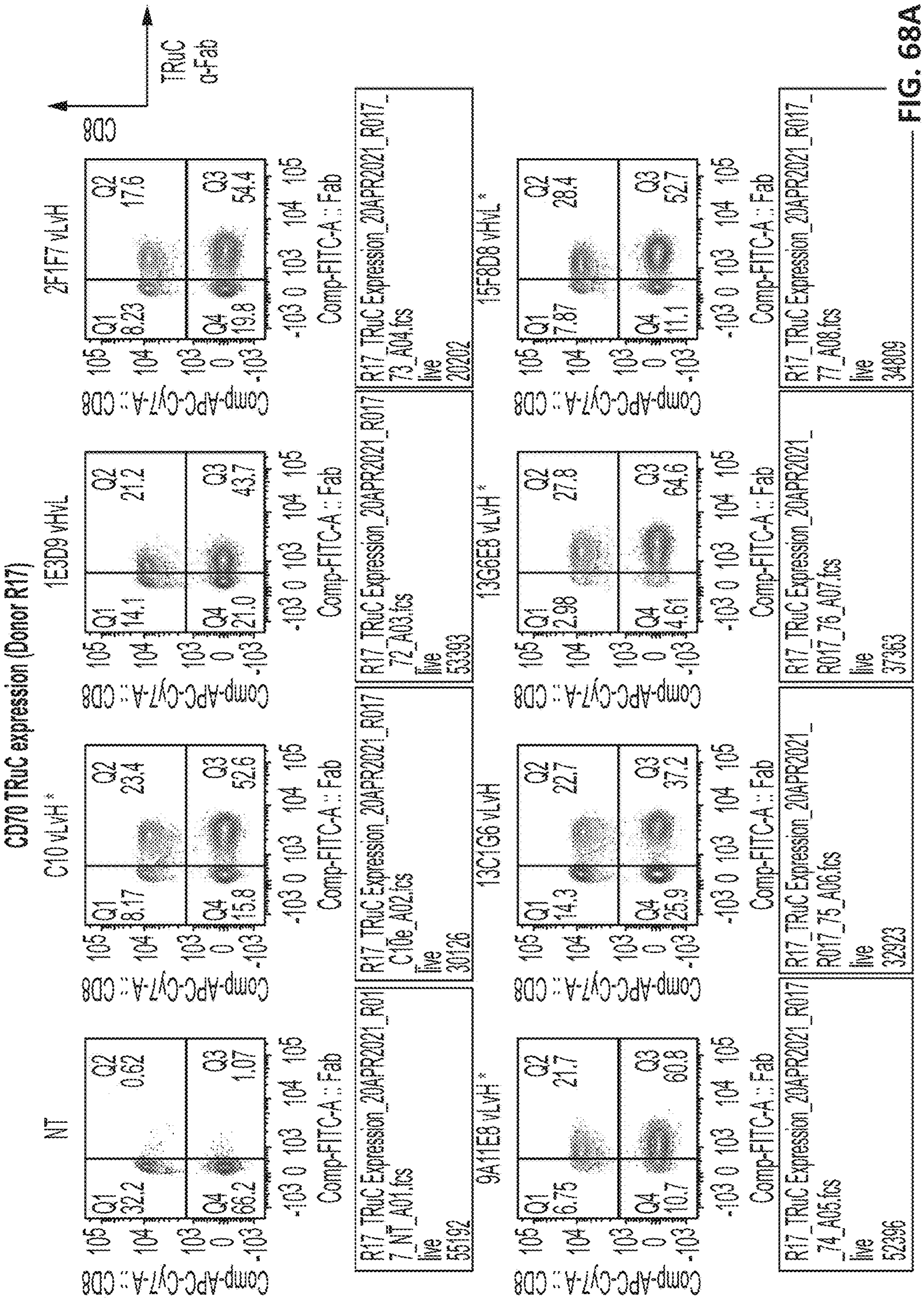
FIGS. 68A and 68B are a series of plots showing CD8 positivity and transduction efficiency as determined by detection of scFv expression in T cells from two representative donor transduced with CD70 TFPs having human scFv binders shown or untransduced controls.
Figure 68B:
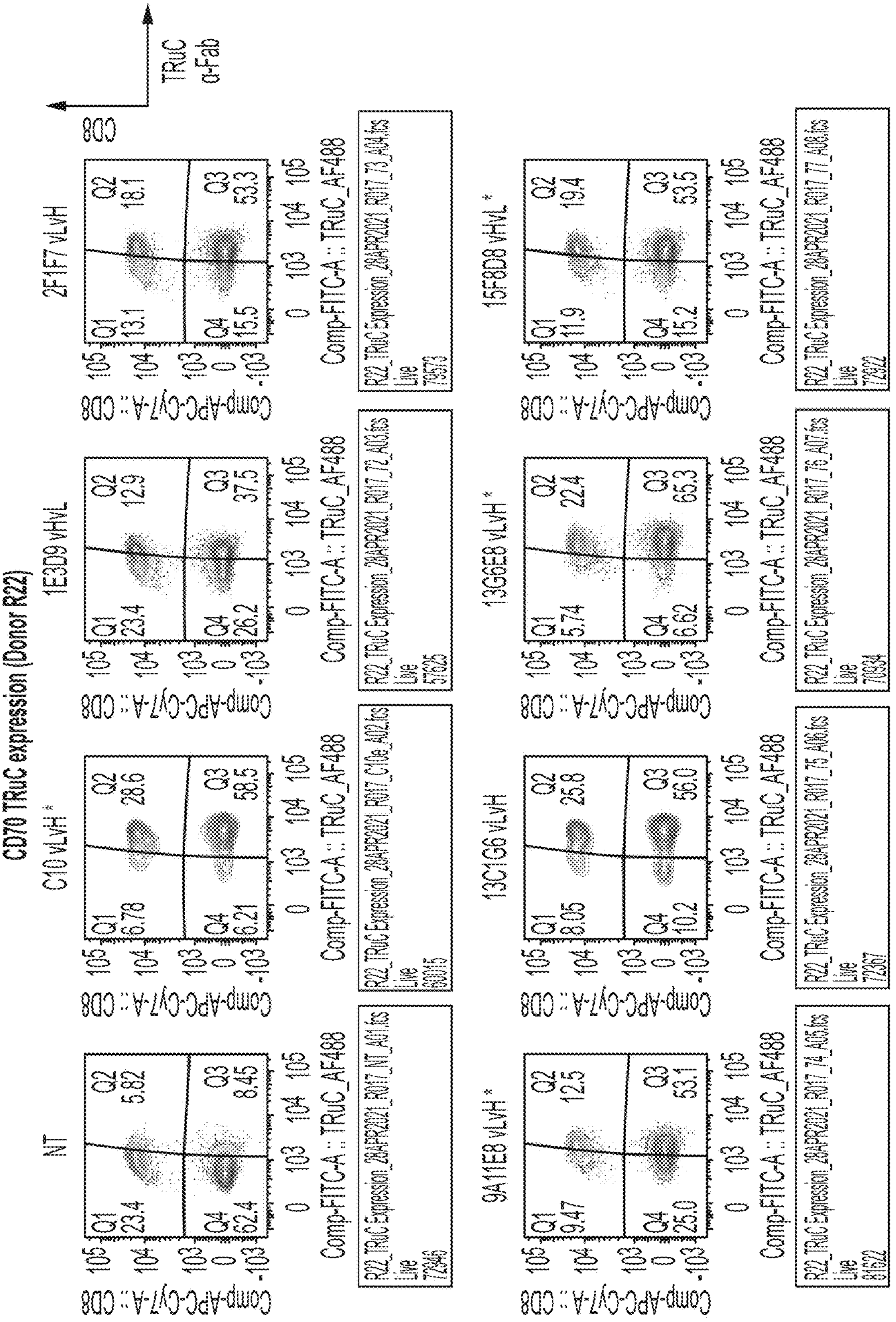

At day 10 of expansion, T cells were harvested and the cells were characterized by flow cytometry. Transduction efficiency was assessed with an anti-Fab antibody. CD8 positivity was also measured. Results for two donors are shown in FIG. 68. All constructs exhibited high transduction efficiency.

Phenotyping of TFP T Cells

Figures 1, 69A:
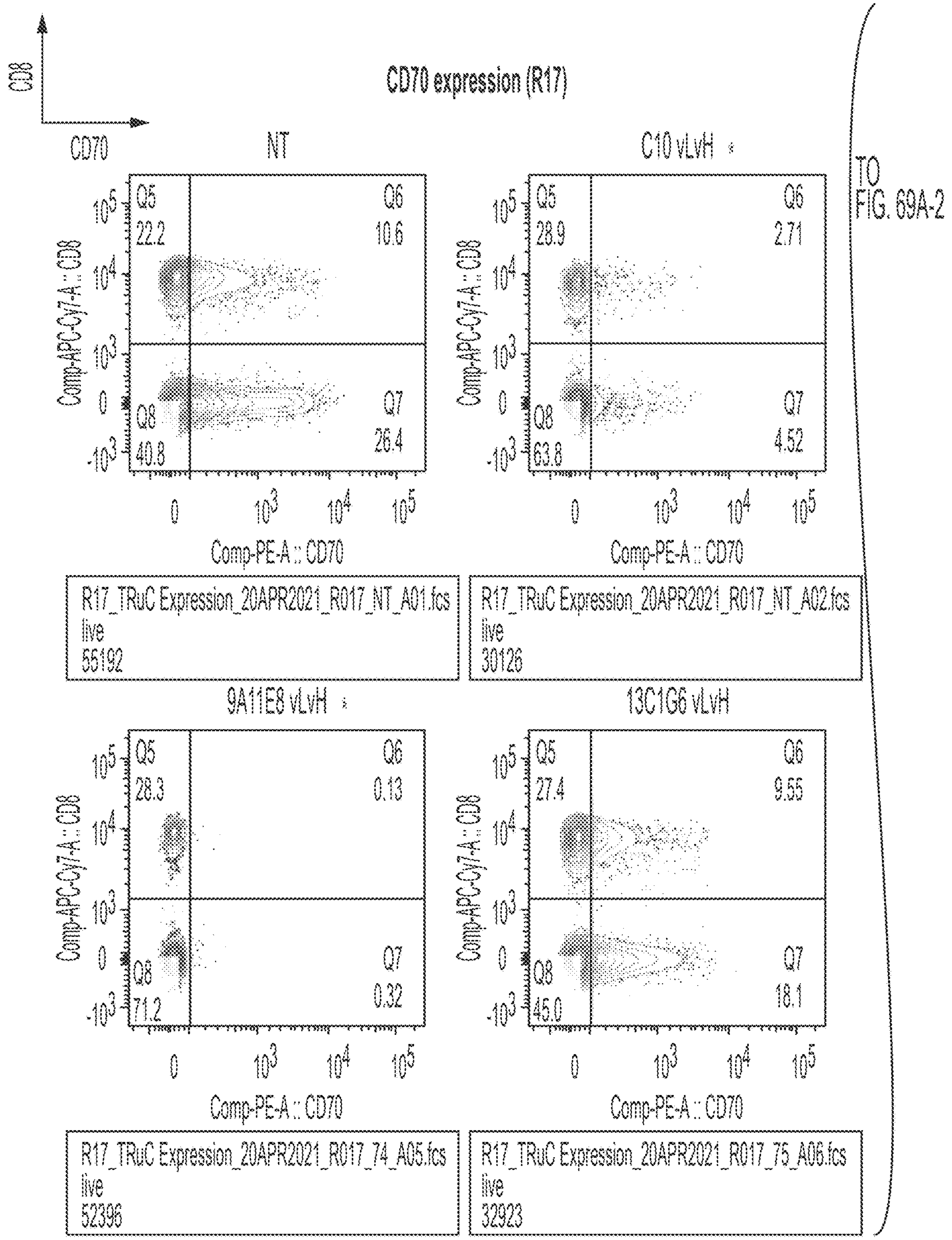
FIGS. 69A and 69B are a series of plots showing flow cytometry data detecting CD70 cell surface expression in T cells from two donors transduced with CD70 TFPs having human scFv binders shown or untransduced controls.
Figures 1, 2, 69A:
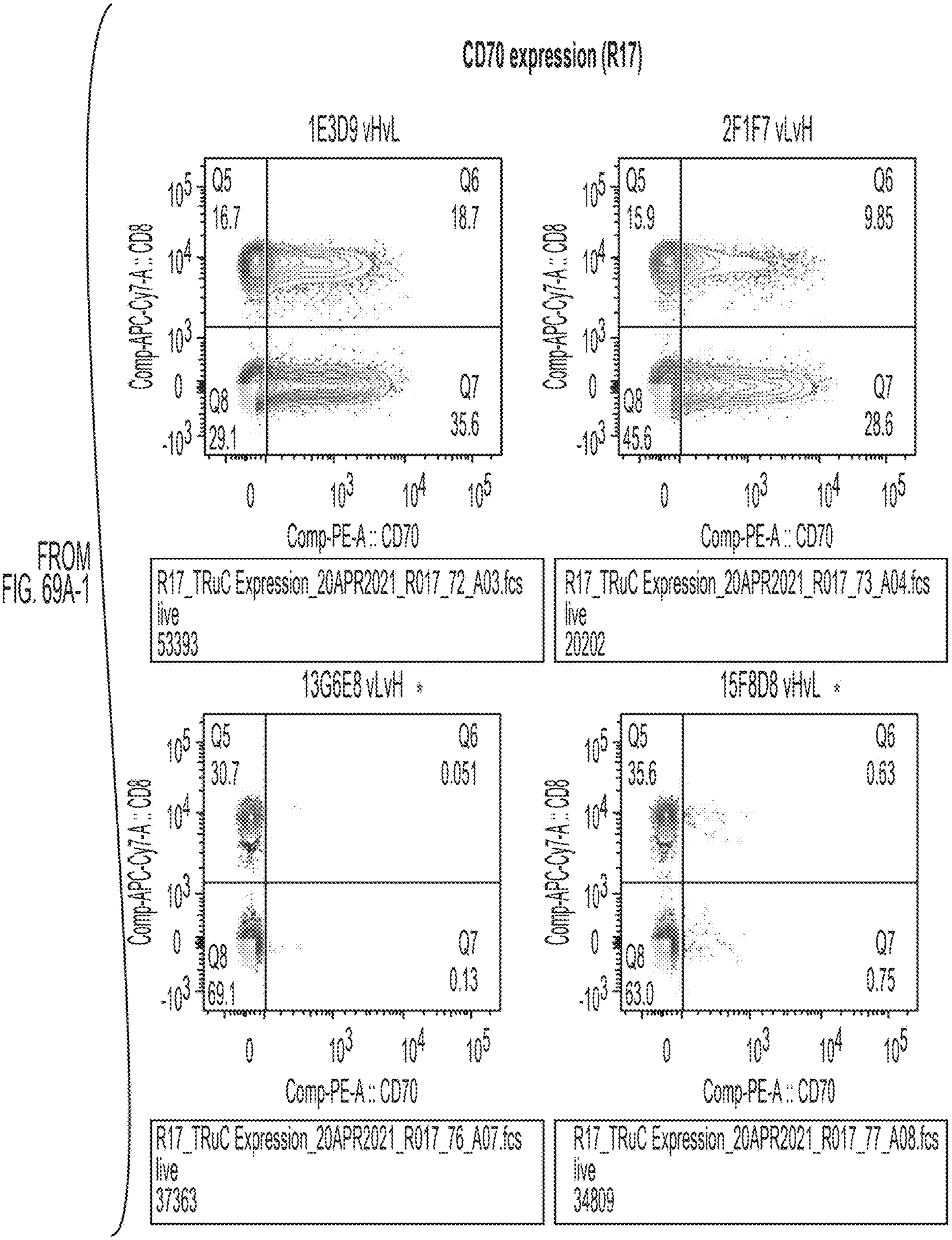
Figure 69B:
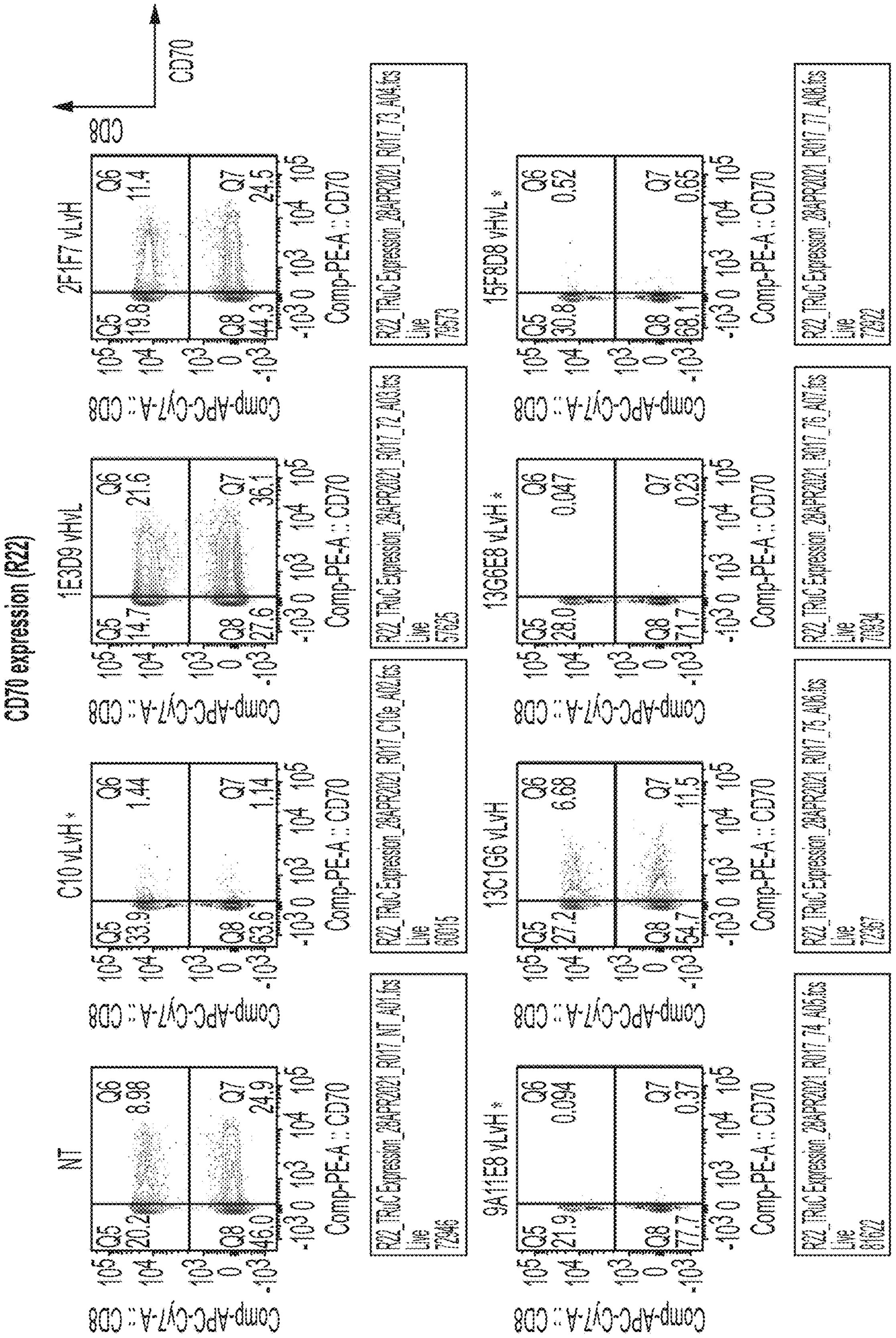
Figures 1, 70A:
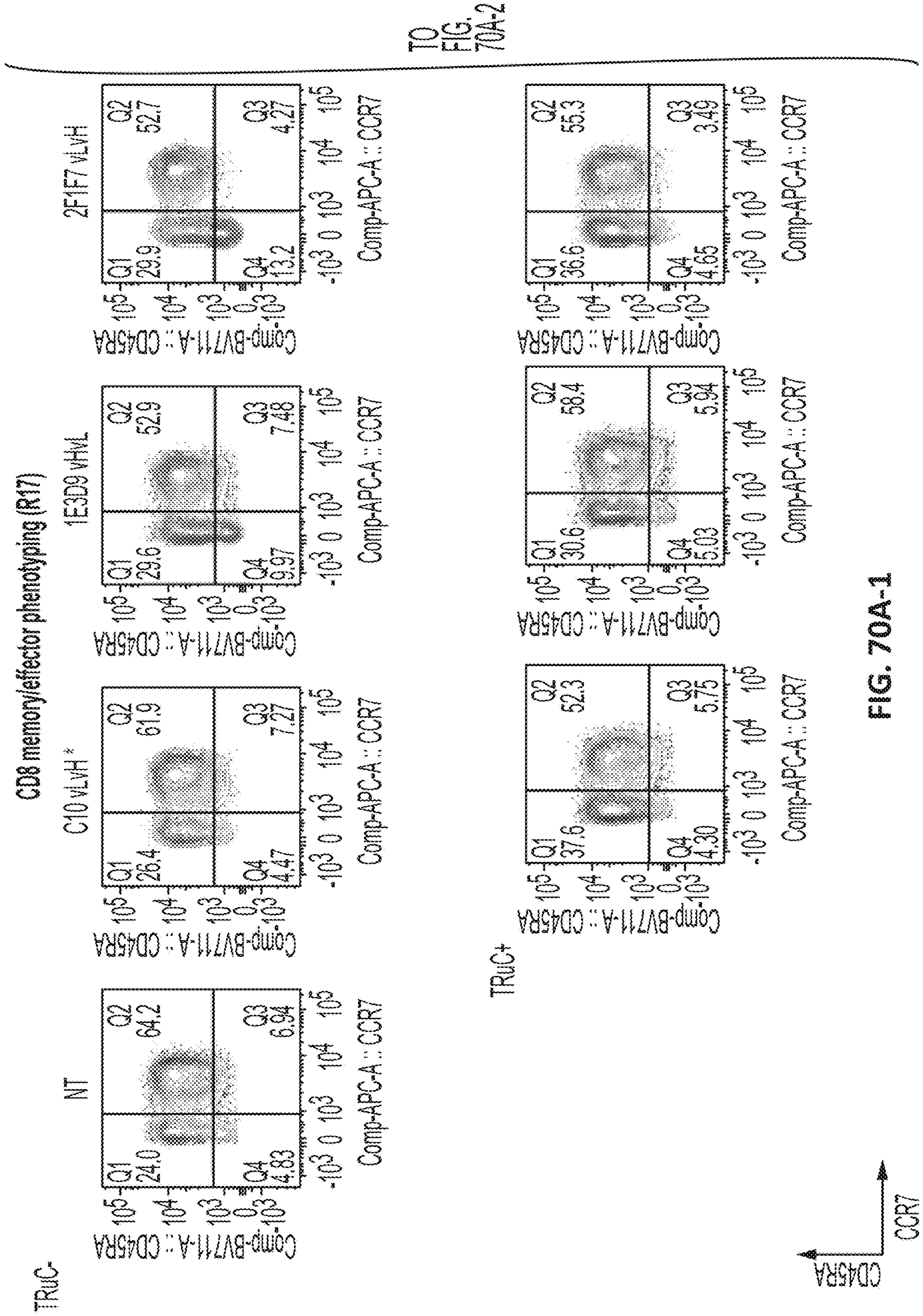
FIGS. 70A-70D are a series of plots showing memory phenotype as determined by flow cytometry detecting cell surface expression of CD45RA and CD27 in T cells from two donors transduced with the CD70 TFPs having human scFv binders shown or untransduced controls.
Figures 2, 70A:
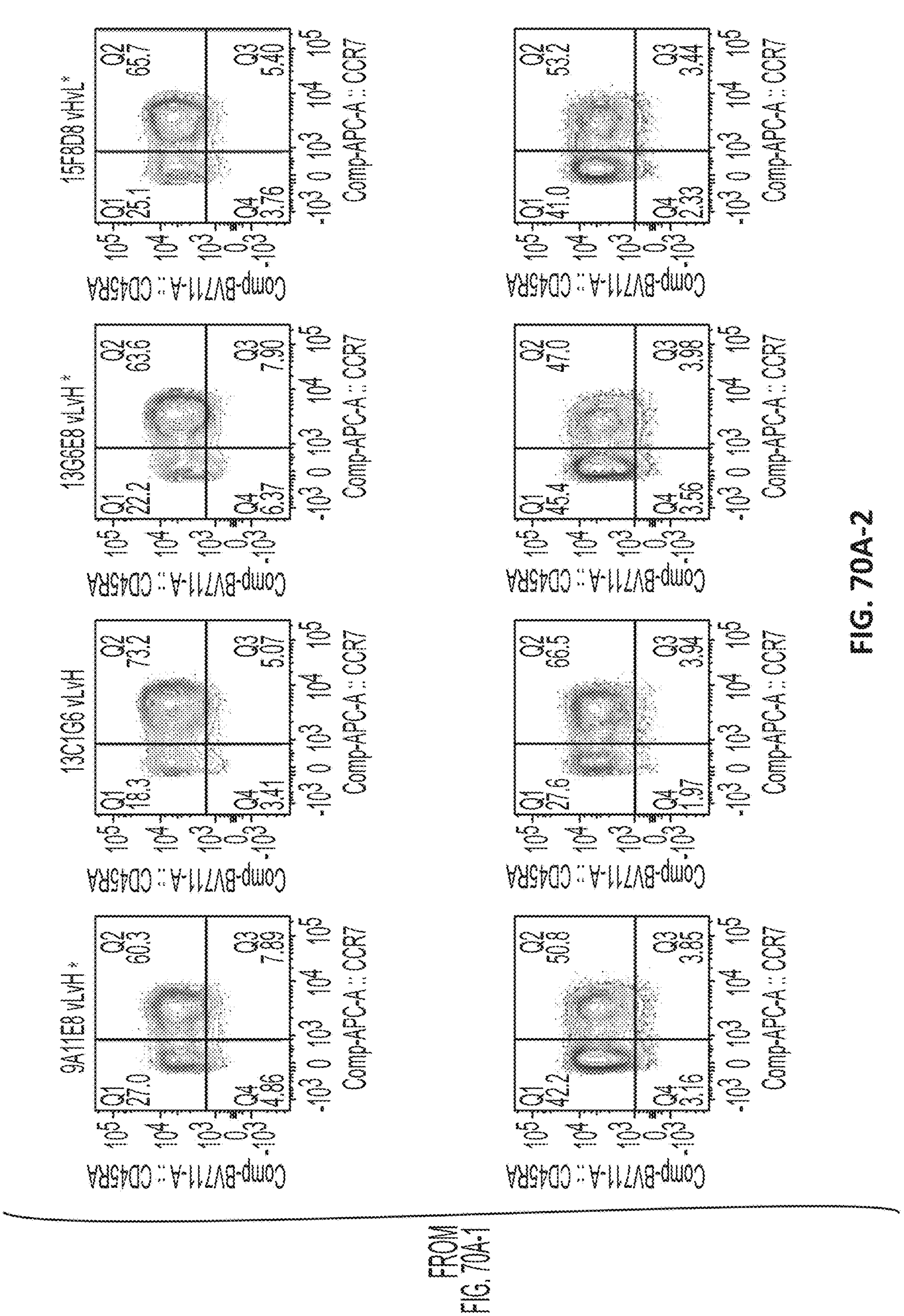
Figures 1, 70B:
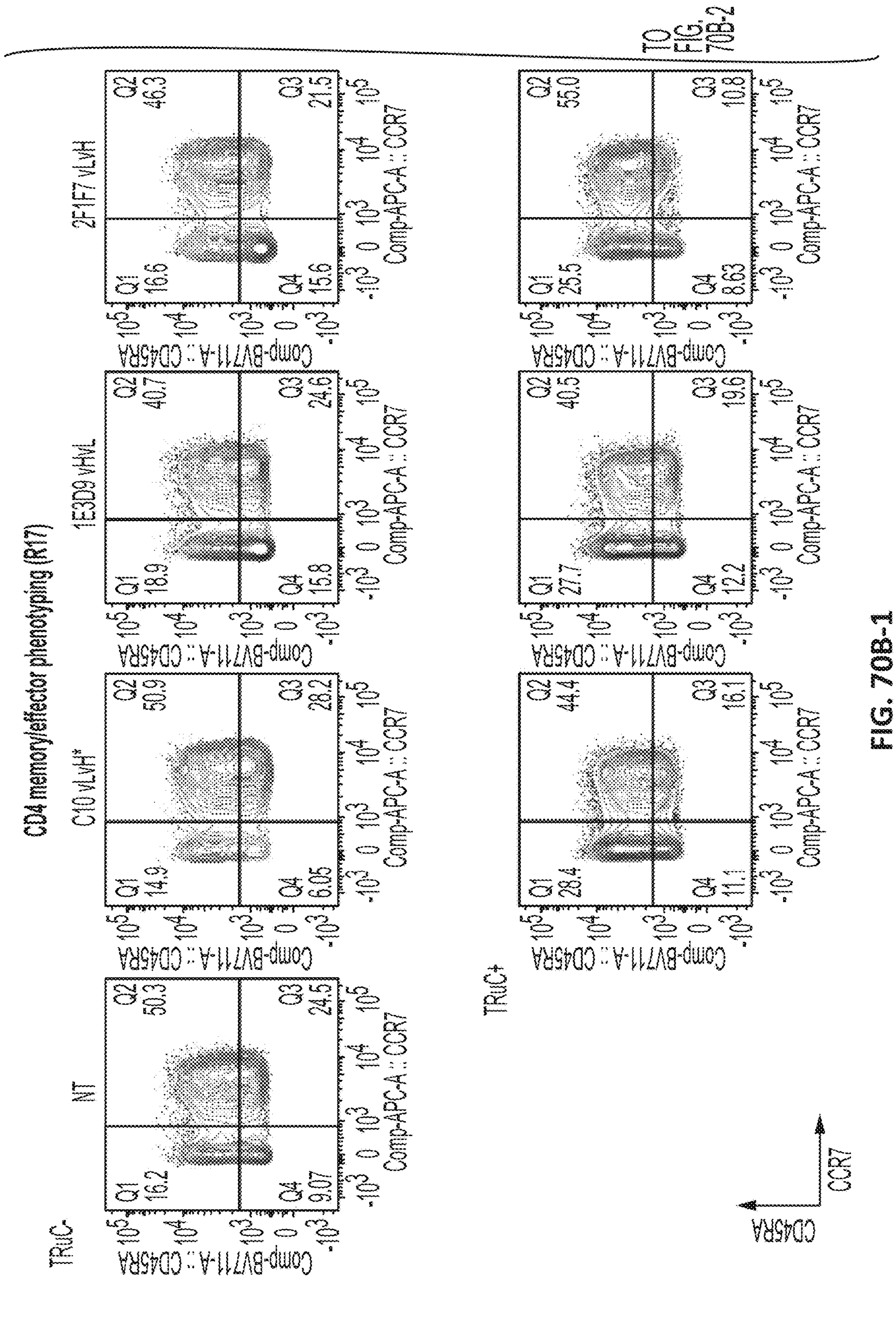
Figures 2, 70B:
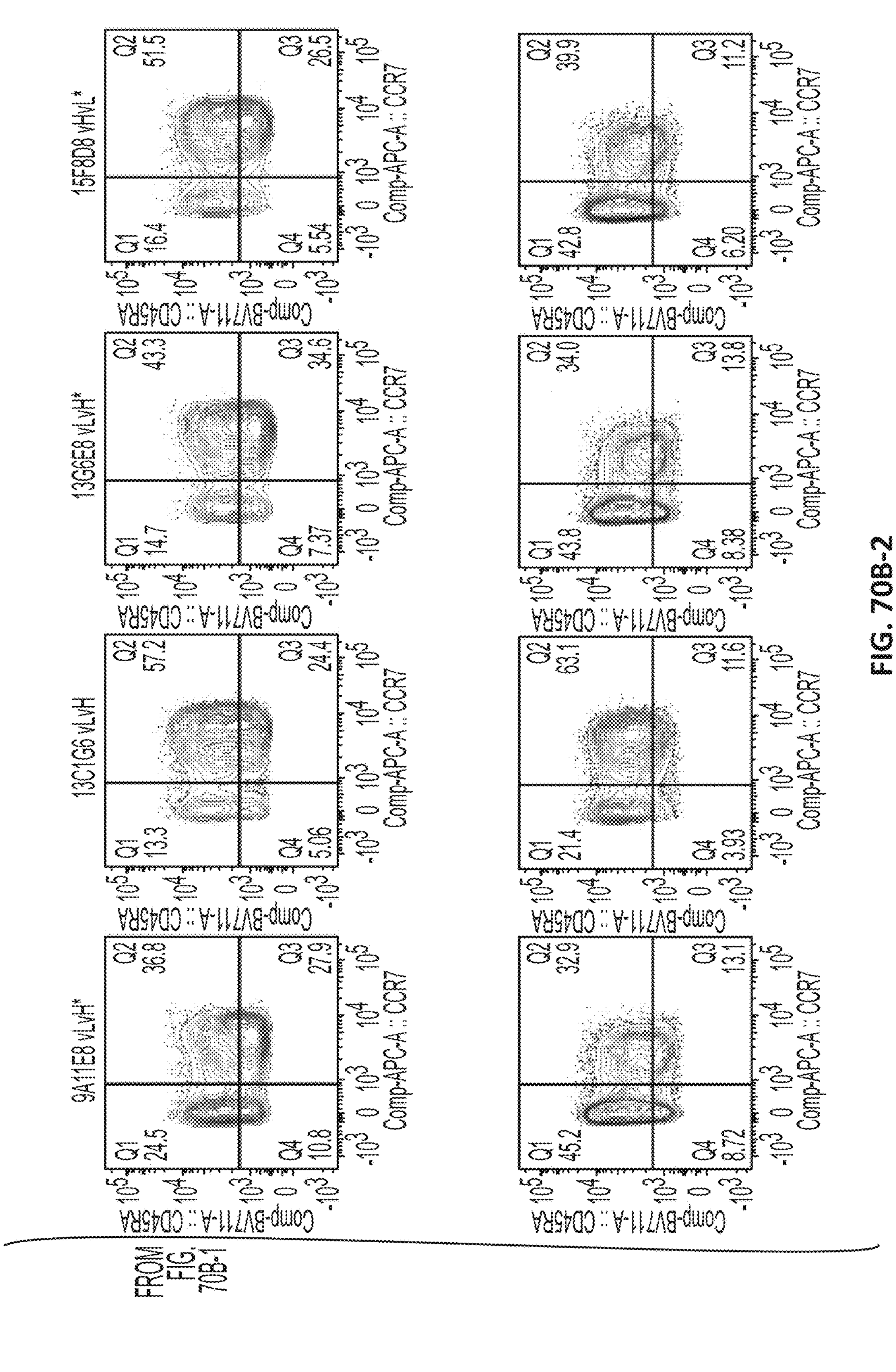
Figures 1, 70C:
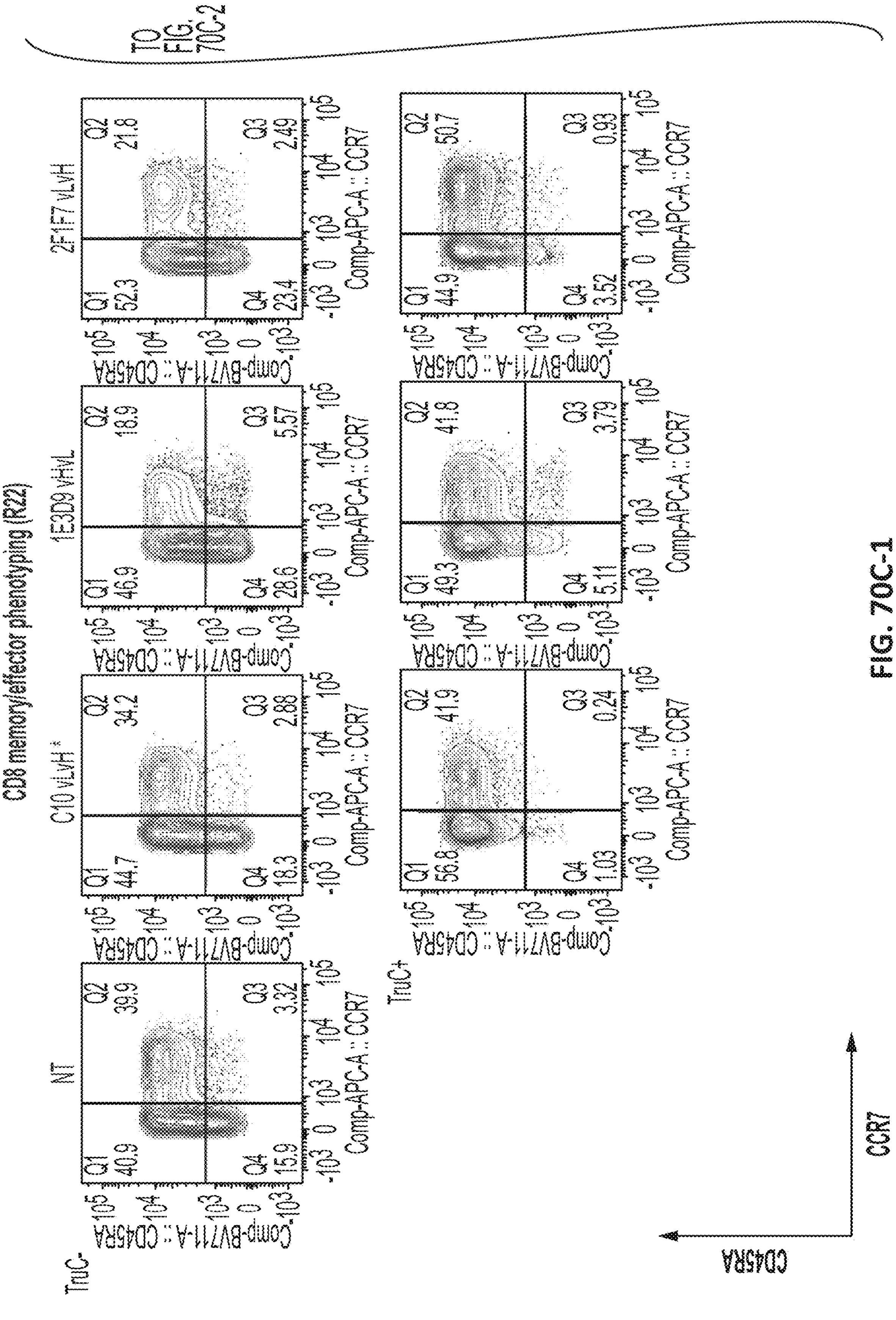
Figures 2, 70C:
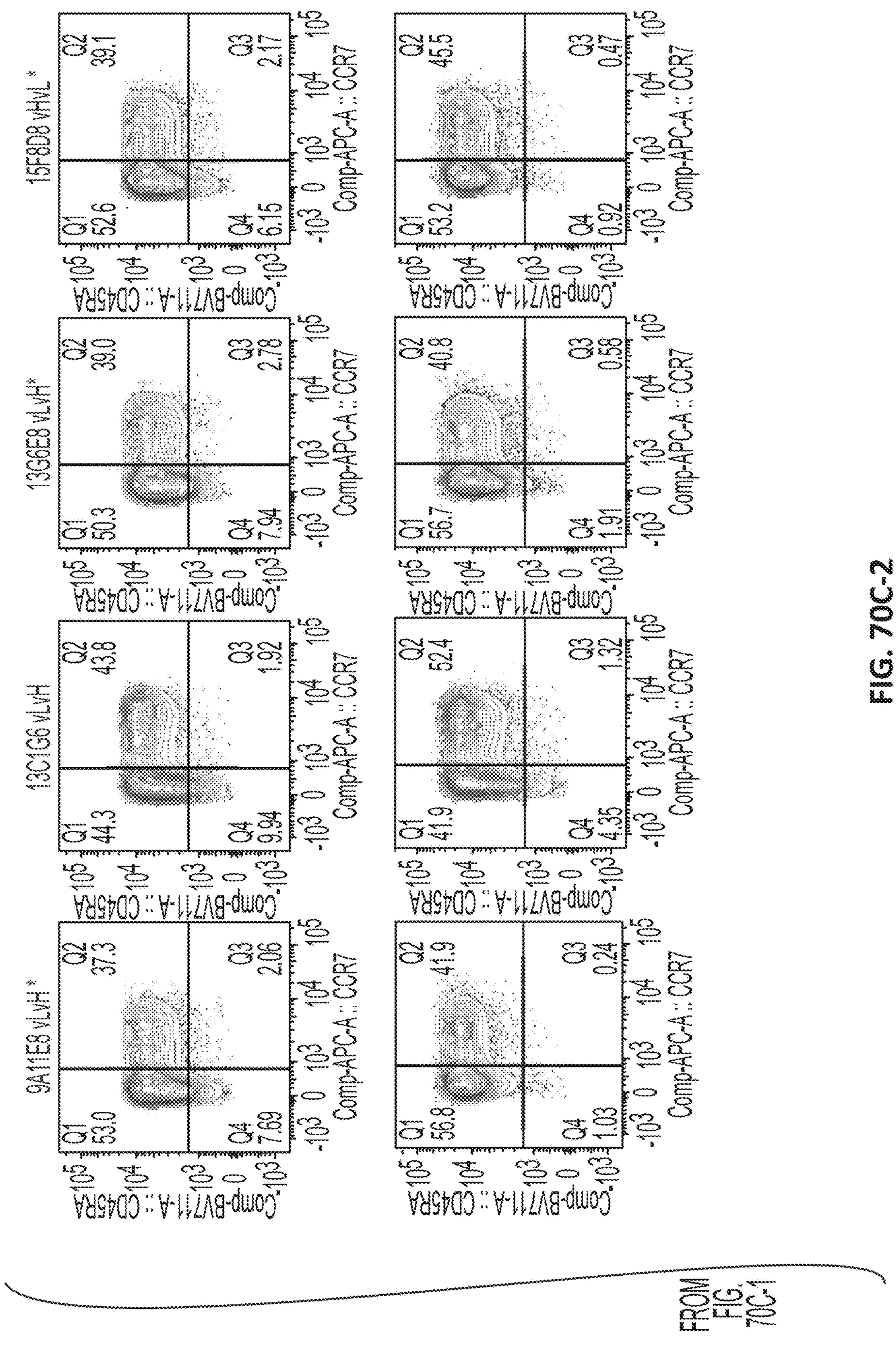
Figures 1, 70D:
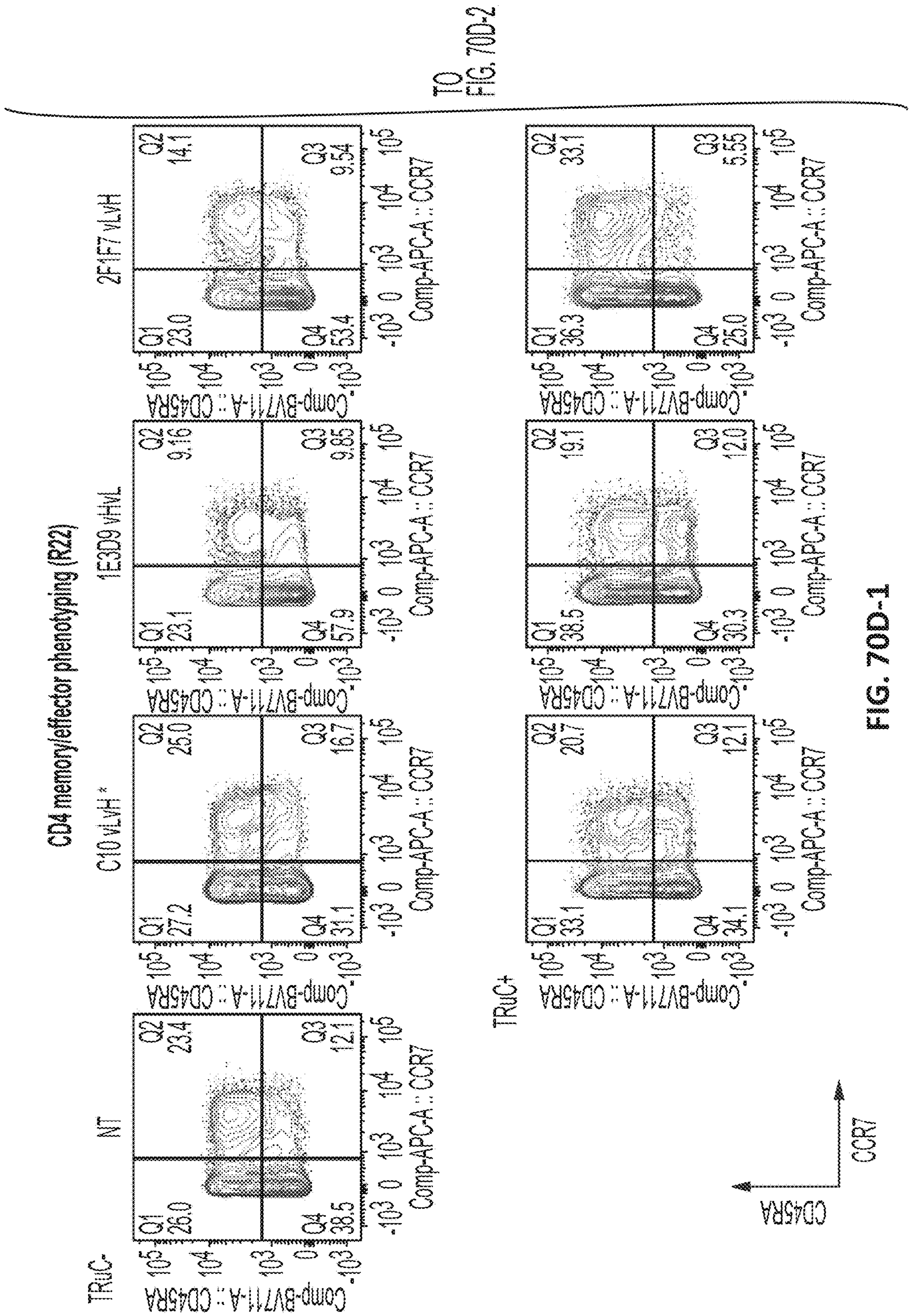
Figures 2, 70D:
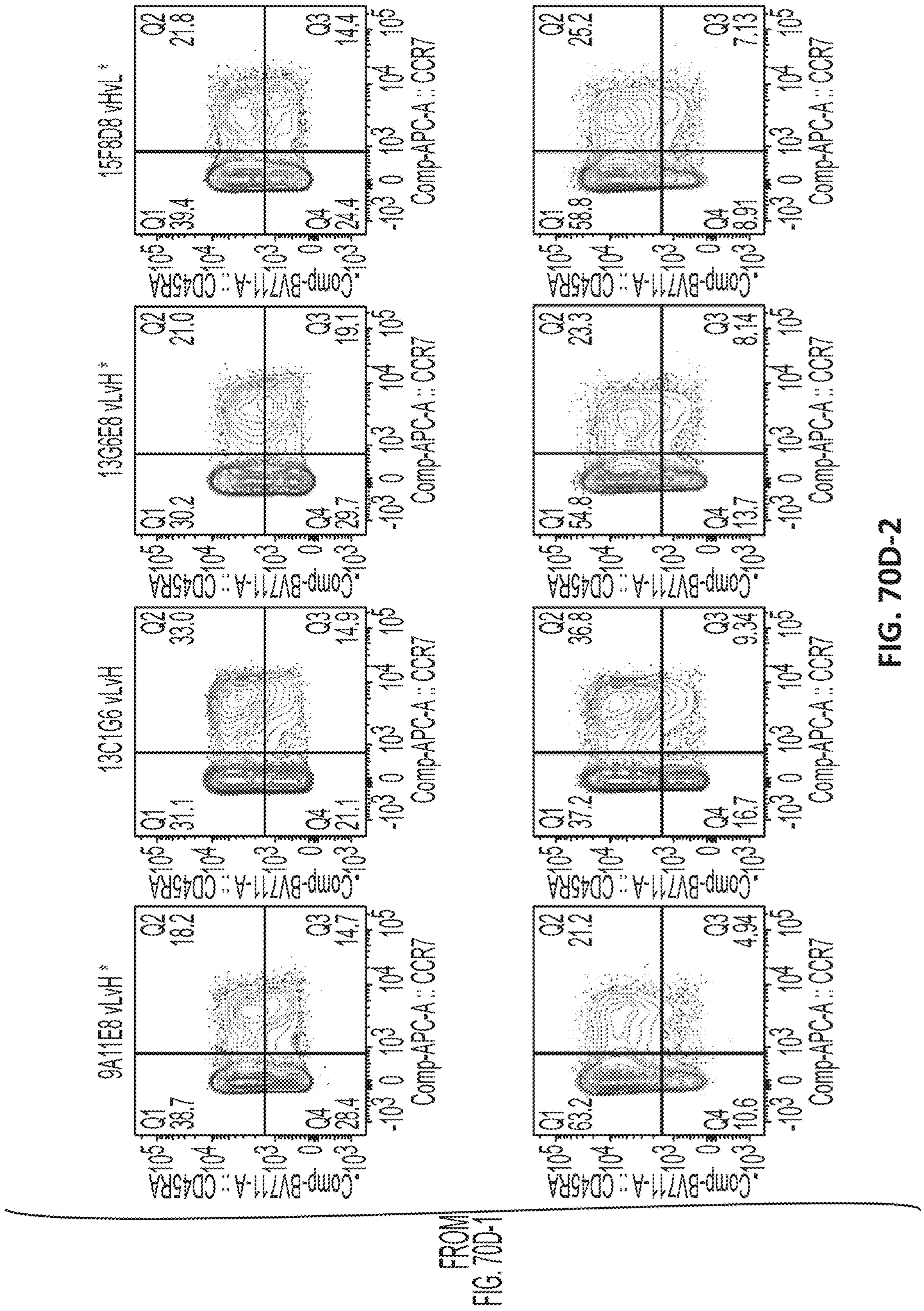

CD70 expression on the surface of transduced T cells was measured in two donors. CD8 expression was also measured to assess the proportion of CD4+ and CD8+ cells expressing CD70. T cells transduced with the C10 TFP, 9A11E8 vLvH TFP, 13G6E8 vLvH TFP, and 15F8D8 vHvL TFP had very low levels of CD70 expressing cells relative to non-transduced controls (FIG. 69).

T-cell differentiation was determined by surface expression of CD45RA and CCR7 in two donors (Naïve, $CD45RA^+CCR7^+$; CM, $CD45RA^-CCR7^+$; EM, $CD45RA^-CCR7^-$; TEMRA, $CD45RA^+CCR7^-$) CD4+ T cells and CD8+ T cells. The results are shown in FIG. 70.

Cytotoxicity of T Cells

CD70 TFP mediated activation of donor T cells expressing the TFP constructs was assessed by assessment of cytotoxicity following co-culture with CD70-negative K562 cells, CD70-positive THP-1 AML cells, and CD70-positive ACHN cells, and CD70 positive 786-O cells.

Figure 71A:
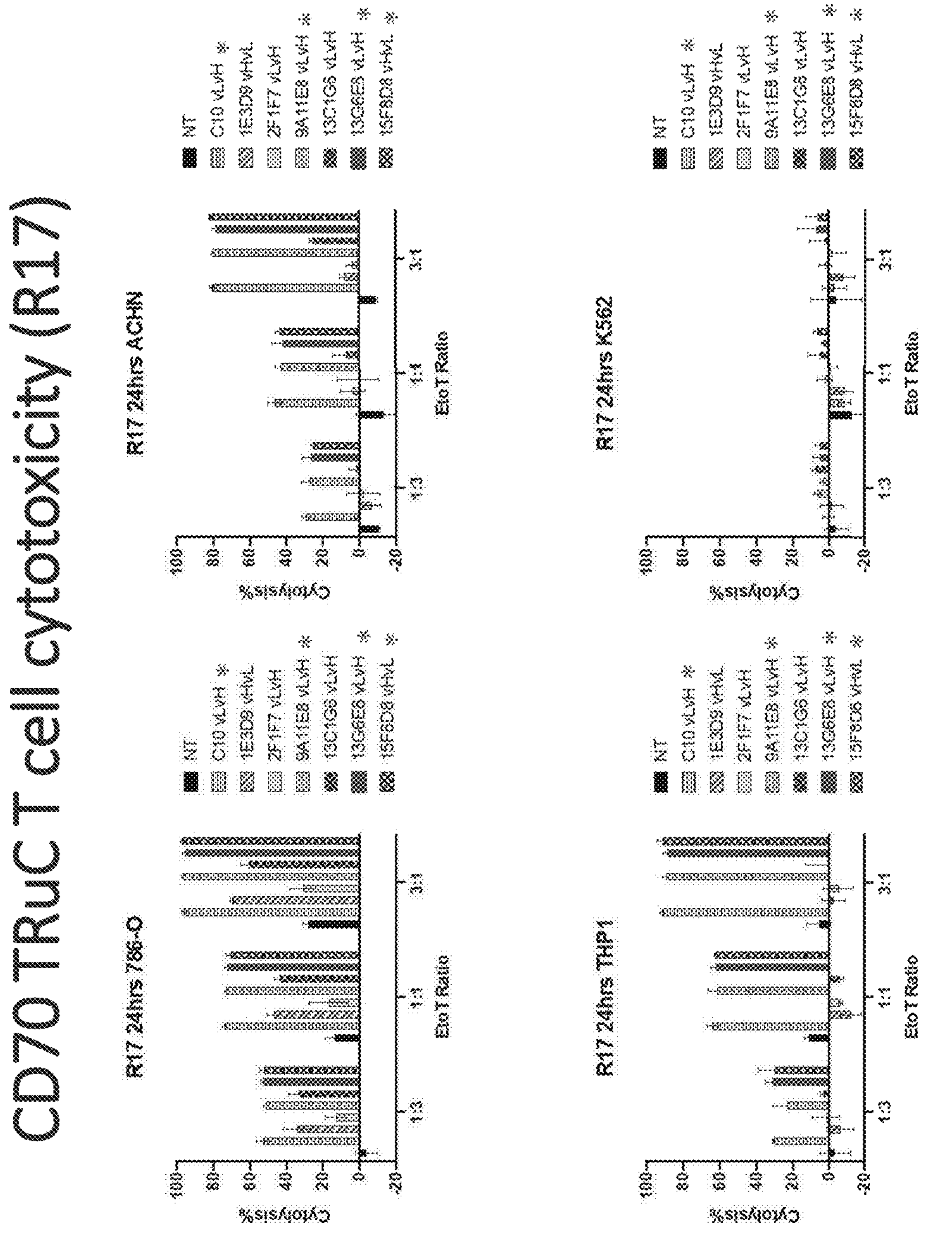
FIGS. 71A and 71B are a series of graphs showing cytotoxicity of T cells from two donors transduced with TFPs having the binders shown or untransduced control T cells when co-cultured for 24 hours with THP-1, ACHN, 786-0, or K562 cells at a 3:1, 1:1, or 1:3 ratio.
Figure 71B:
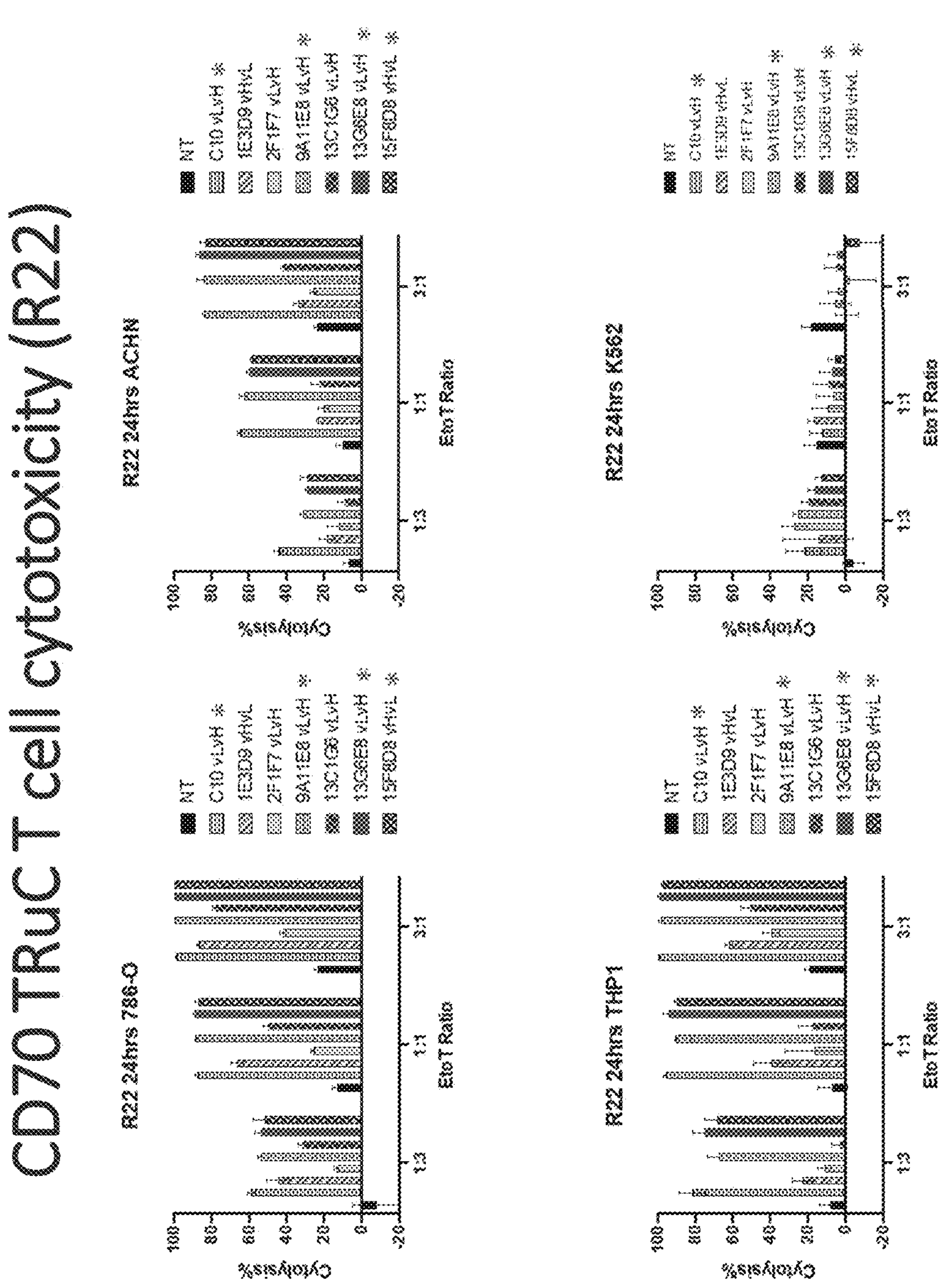

Cytotoxicity was measured as is described in Example 7. CD70 TFP expressing T cells or controls were co-cultured with luciferase expressing THP-1, ACHN, 786-0, or K562 cells at a 3:1, 1:1, or 1:3 ratio for 24 hours. The luciferase activity in live target cells was then measured and cytotoxicity calculated as described above. Data for two donors is shown in FIG. 71. As is shown, T cells expressing the C10 TFP, 9A11E8 vLvH TFP, 13G6E8 vLvH TFP, and 15F8D8 vHvL TFP exhibited cytotoxicity towards CD70-expressing cells but not towards K562 cells, which do not express CD70.

Example 21: In Vivo Efficacy of CD70 TFPs

RCC Mouse Model

Anti-tumor efficacy in vivo of CD70.TFP expressing T cells with or without the PD-1 switch generated in the presence or absence of anti-CD70 antibody as described above was evaluated in the subcutaneous human Renal Cell carcinoma, 786-0, NSG mouse model.

NSG mice were injected SC with $3\times10^6$ 786-O-luc cells (200 ul) into the flank. Eighteen days post tumor implant, when mice had a tumor volume of 100-150 $mm^3$, mice were assigned to efficacy groups (N=5) such that each group had the same mean tumor volume (+/−10%). Mice were injected IV with $3\times10^6$ CD70 TFP T cells (with or without the PD-1 switch) or ~$3.3\times10^6$ total T cells (NT). A vehicle group of mice was treated with RPMI vehicle. The day of test article injection was Study Day 0. Tumor volumes were determined by caliper measurements 2× per week.

Figure 72A:
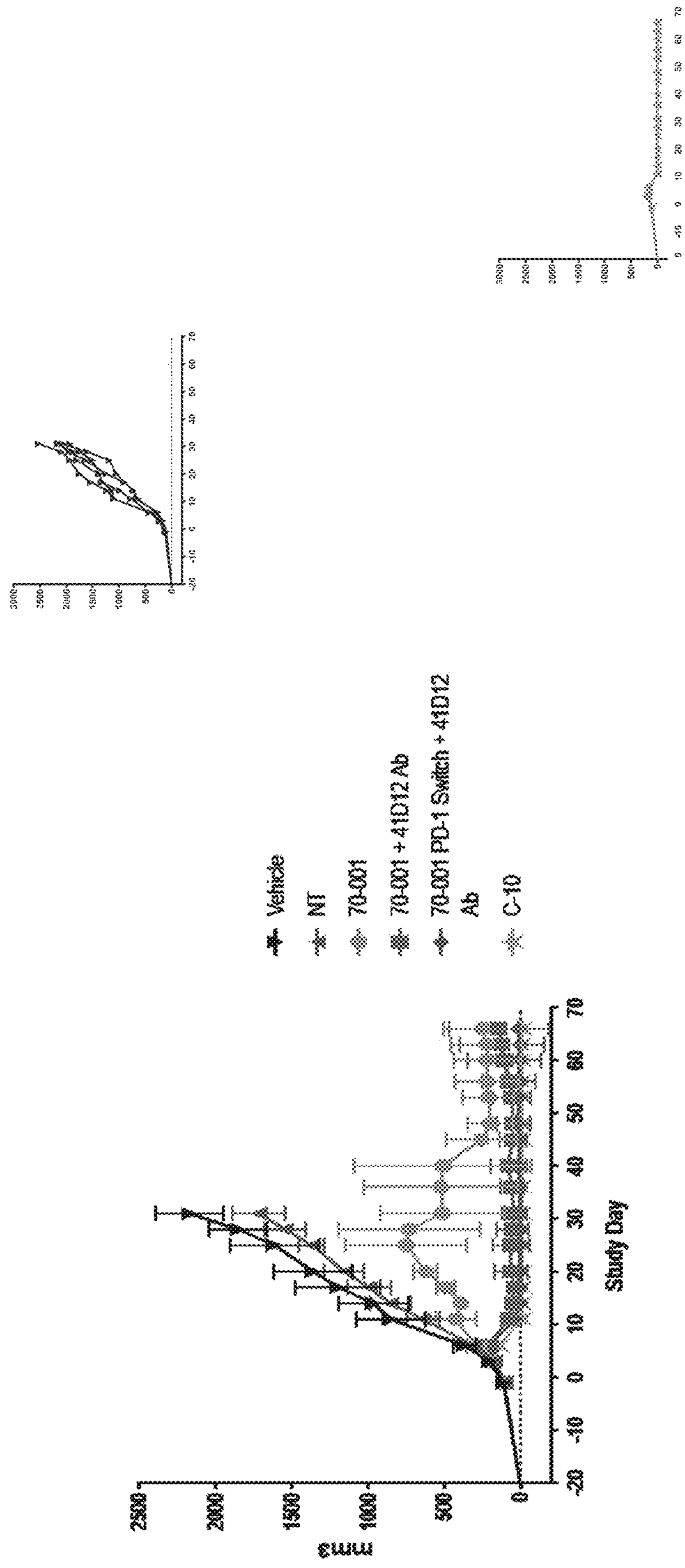
FIGS. 72A and 72B are a series of graphs showing tumor volume in mice treated with CD70 TFP+ T cells generated according to the methods described in Example 21 in the presence and absence of anti-CD70 antibody in a murine model of Renal Cell Carcinoma.

As is shown in FIG. 72A, mice treated with 70-001 CD70 TFP T cells (with or without the PD-1 switch) generated in the presence of the anti-CD70 antibody, and mice treated with C10 CD70 TFP T cells (generated in the absence of the anti-CD70 antibody) had dramatically reduced tumor volume relative to mice treated with 70-001 CD70 TFP T cells generated in the absence of the CD70 antibody and relative to mice treated with vehicle or untransduced T cells.

Figure 72B:
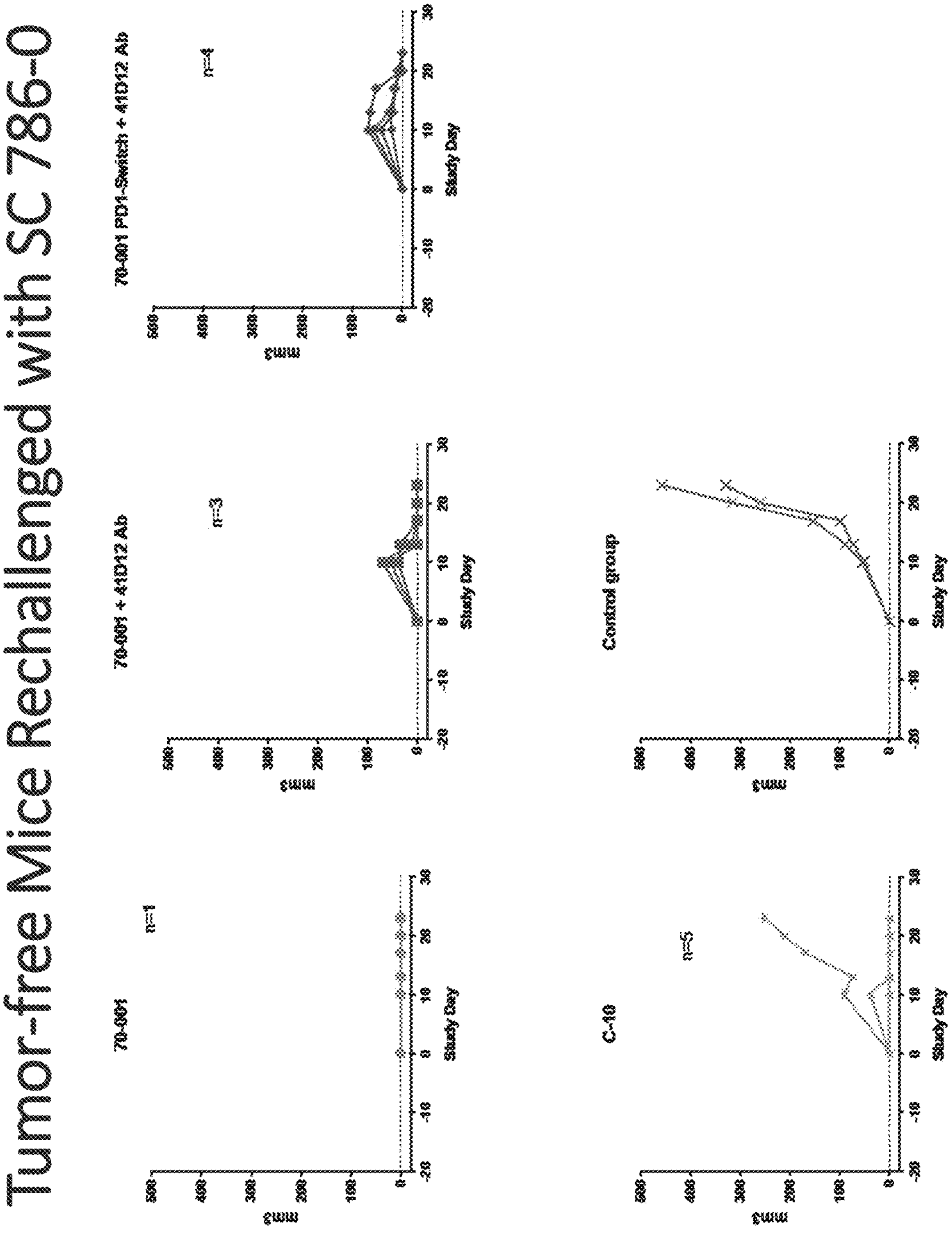

Tumor-free mice were then rechallenged on study day 43 with $3\times10^6$ of 786-O cells (s.c.) per animal. Naïve mice that received no treatment were inoculated with tumor cells as a control. Results are shown in FIG. 72B. Mice treated with any of the CD70 TFPs continued to exhibit a reduction in tumor volume relative to control mice. The results demonstrate CD70-targeted TFP T cells exhibit potent and persistent in vivo efficacy.

Systemic Human Burkitt's Lymphoma, Raji Mouse Model

Anti-tumor efficacy in vivo of CD70.TFP expressing T cells with or without the PD-1 switch generated in the presence or absence of anti-CD70 antibody as described above was evaluated in the systemic Human Burkitt's Lymphoma, Raji mouse model.

NSG mice were injected IV in the tail vein with $5\times10^5$ Raji-luc cells in 100 ul. Four days post tumor implant, when mice had a whole body luminescence of 5-7e6, mice were assigned to efficacy groups (N=5) such that the mean tumor volume per group was similar. Mice were injected IV with $2\times10^6$ CD70 TFP T cells (with or without the PD-1 switch) or ~$3.3\times10^6$ total T cells (NT). A vehicle group of mice was treated with RPMI vehicle. The day of test article injection was Study Day 0. Tumor growth was determined by IVIS bioluminescence whole body imaging twice per week.

Figure 73A:
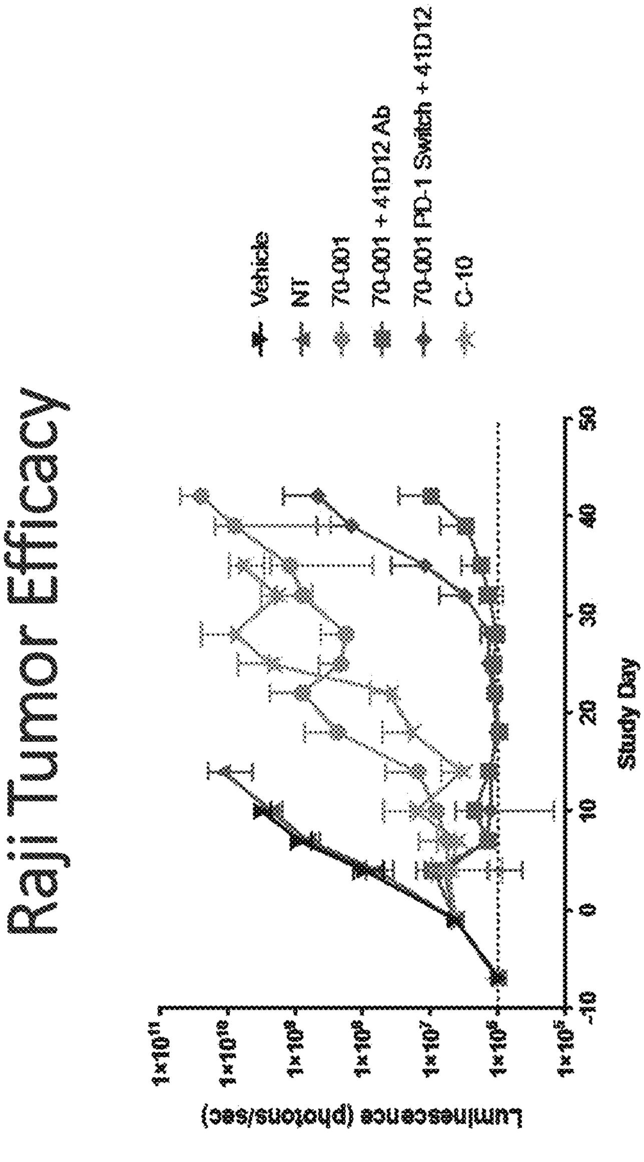
FIGS. 73A-73C show tumor growth in mice treated with CD70 TFP+ T cells generated according to the methods described in Example 21 in the presence and absence of anti-CD70 antibody in a murine model of systemic Human Burkitt's Lymphoma. Tumor growth was determined by luminescence.
Figure 73B:
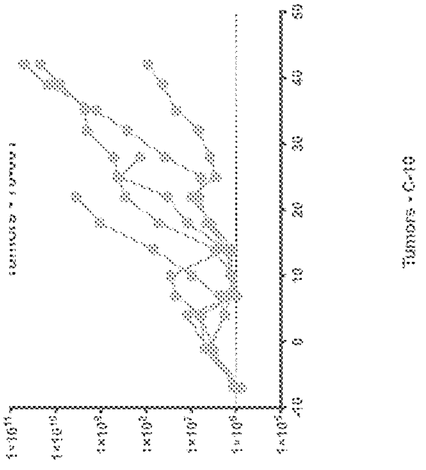
Figure 73C:
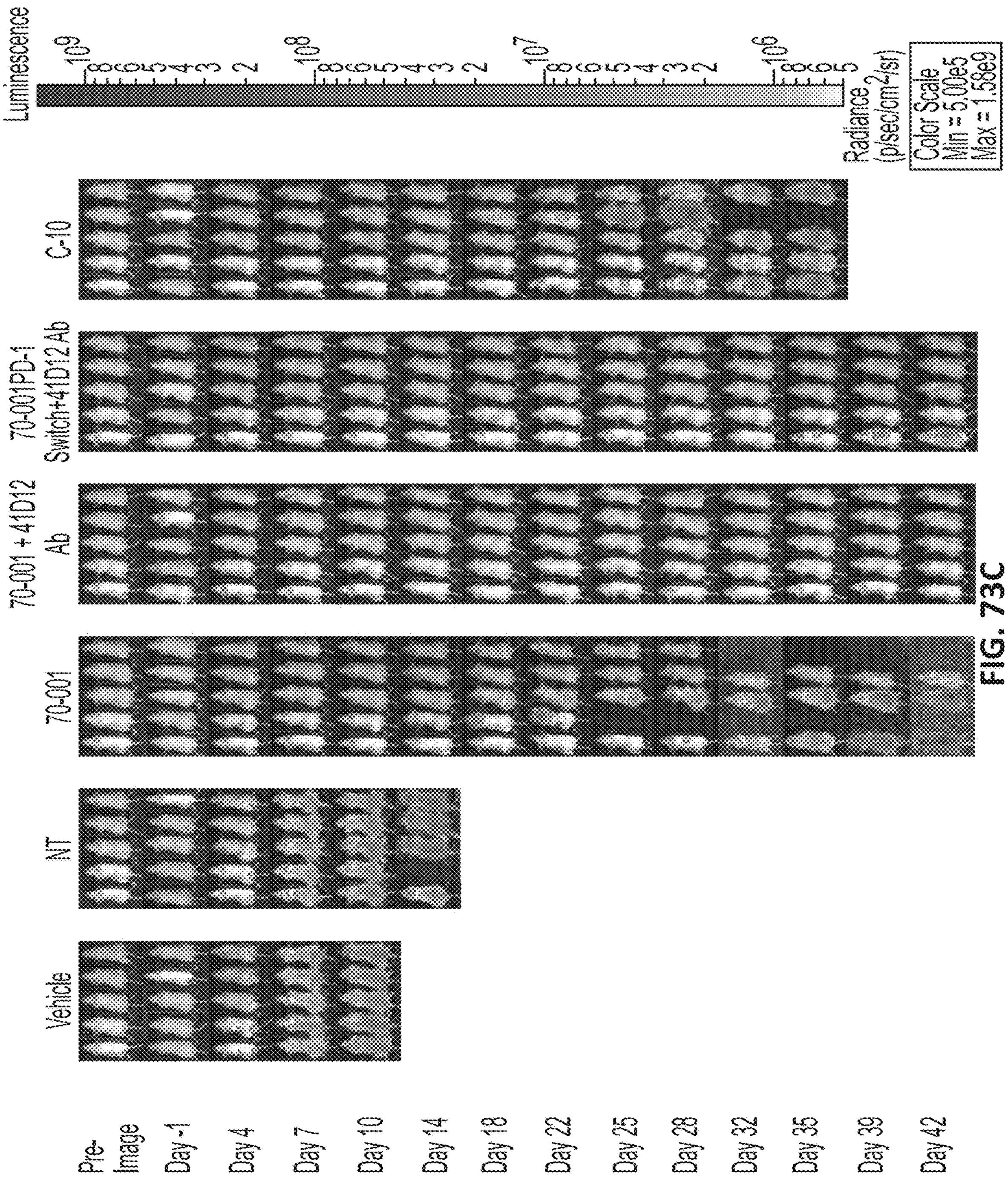

As is shown in FIG. 73, mice treated with 70-001 CD70 TFP T cells or C10 CD70 TFP cells reduced tumor volume relative to untransduced T cells. 70-001 TFP cells (with or without the PD-1 switch) generated in the presence of the anti-CD70 antibody had dramatically reduced tumor volume relative to mice treated with CD70 TFP T cells generated in the absence of the CD70 antibody and relative to mice treated with vehicle or untransduced T cells.

Systemic Human Acute Myeloid Leukemia, MOLM-13 Mouse Model

Anti-tumor efficacy in vivo of CD70.TFP expressing T cells generated in the presence or absence of anti-CD70 antibody as described above was evaluated in the systemic Human Acute Myeloid Leukemia, MOLM-13 mouse model.

NSG mice were injected i.v. with $5\times10^4$ MOLM-13-Luc cells. Four days later, when mice have whole body luminescence of $5\times10^6$-$9\times10^6$, on study day 0, tumor-bearing mice received single infusions of the indicated TFP T cells IV. Individual animals were administered $5\times10^6$ or $1\times10^7$ TRuC-T cells or ~$1.7\times10^7$ total T cells (NT). N=5 mice/group. A vehicle group of mice was treated with RPMI vehicle. Tumor growth was determined by IVIS bioluminescence whole body imaging twice per week.

Figure 74A:
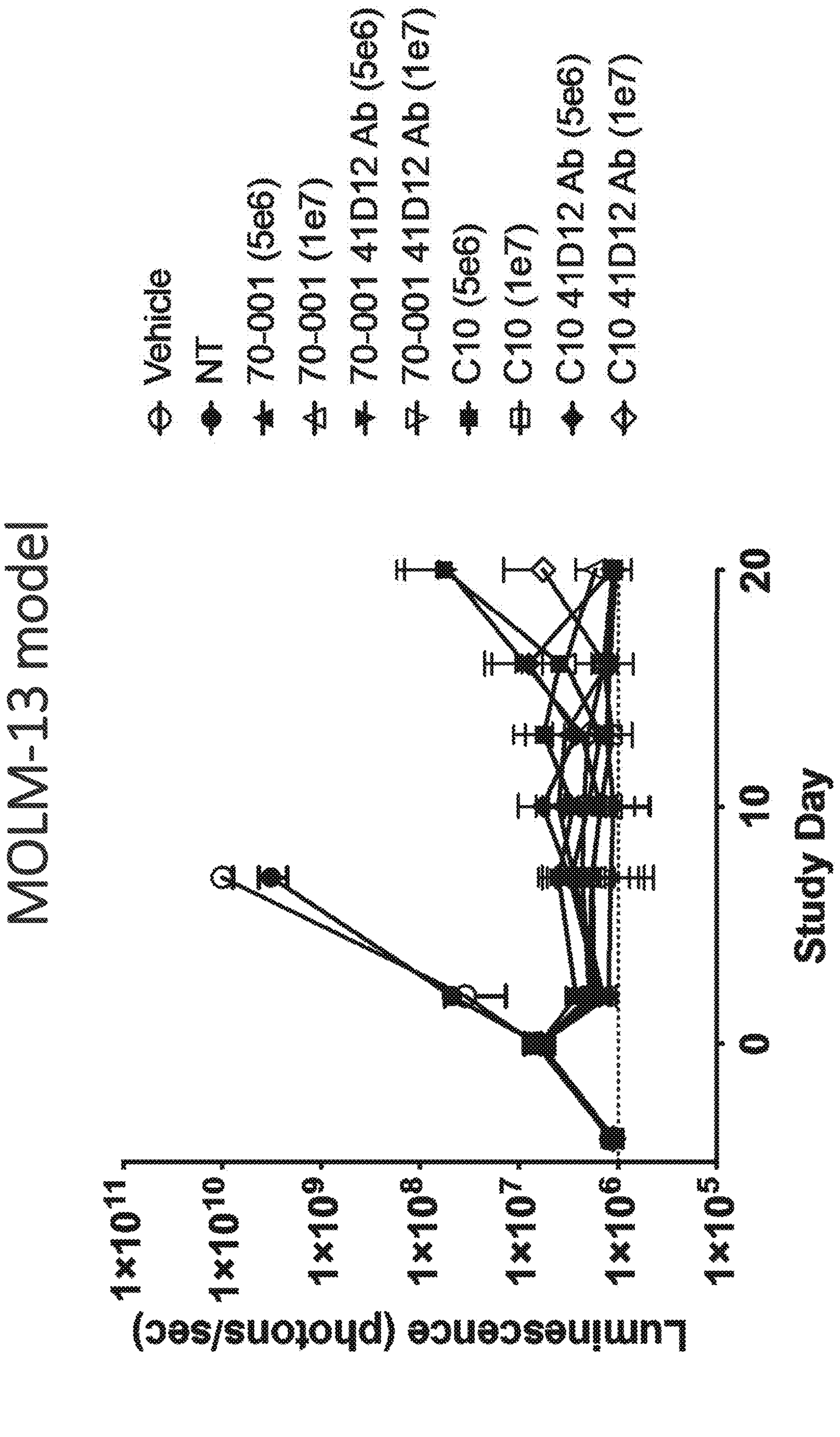
FIGS. 74A and 74B shows tumor growth in mice treated with CD70 TFP+ T cells generated according to the methods described in Example 21 in the presence and absence of anti-CD70 antibody in a murine model of systemic Human Acute Myeloid Leukemia. Tumor growth is determined by luminescence.
Figure 74B:
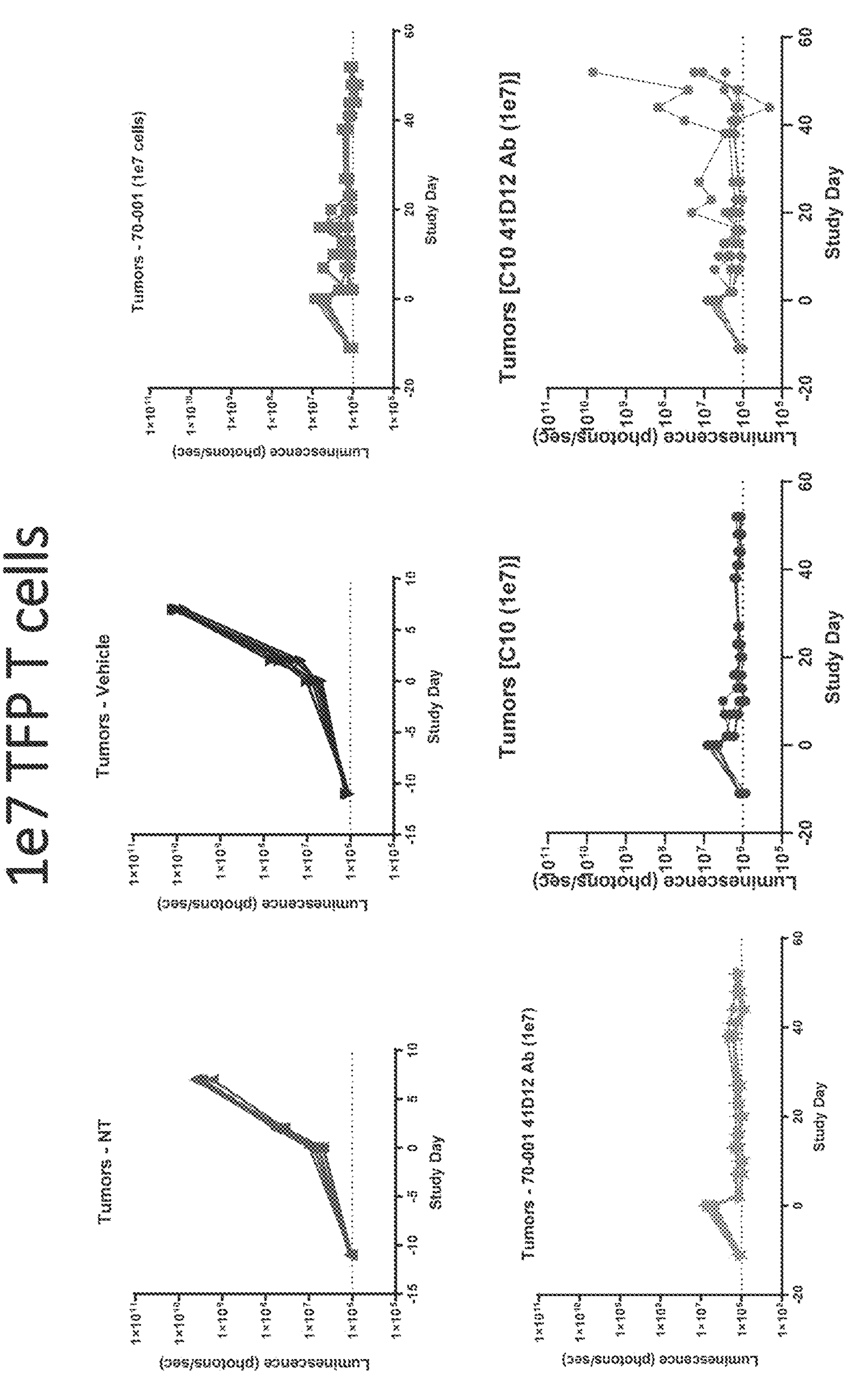

As is shown in FIG. 74, mice treated with 70-001 CD70 TFP T cells or C10 CD70 TFP cells reduced tumor volume relative to untransduced T cells. The reduction of tumor volume was particularly pronounced when $1\times10^7$ TRuC-T cells were used, regardless of whether the TFP T cells were generated in the presence of the absence of the 41D12 antibody.

ACHN Renal Carcinoma Murine Model

Anti-tumor efficacy in vivo of CD70.TFP expressing T cells generated in the presence or absence of anti-CD70 antibody as described above was evaluated in the subcutaneous human Renal Cell carcinoma, ACHN, NSG mouse model.

NSG mice were injected SC with $2\times10^6$ ACHN-luc cells in 200 ul with 1:1 Matrigel into the flank. Twelve days post tumor implant, when mice had a tumor volume of ~150 mm3 (50-200 mm3), mice were assigned to efficacy groups (N=5) such that the mean tumor volume per group was be similar (+/−10%). The remaining mice were sorted into satellite cohorts (N=6 for vehicle control group, NT) such that each group had the same mean tumor volume (+/−10%). Mice were injected IV with $5\times10^6$ CD70 TFP T cells or ~$7\times10^6$ total T cells (NT). A vehicle group of mice was treated with RPMI vehicle. The day of test article injection was Study Day 0. Tumor volumes were determined by caliper measurements 2× per week.

Figure 75:
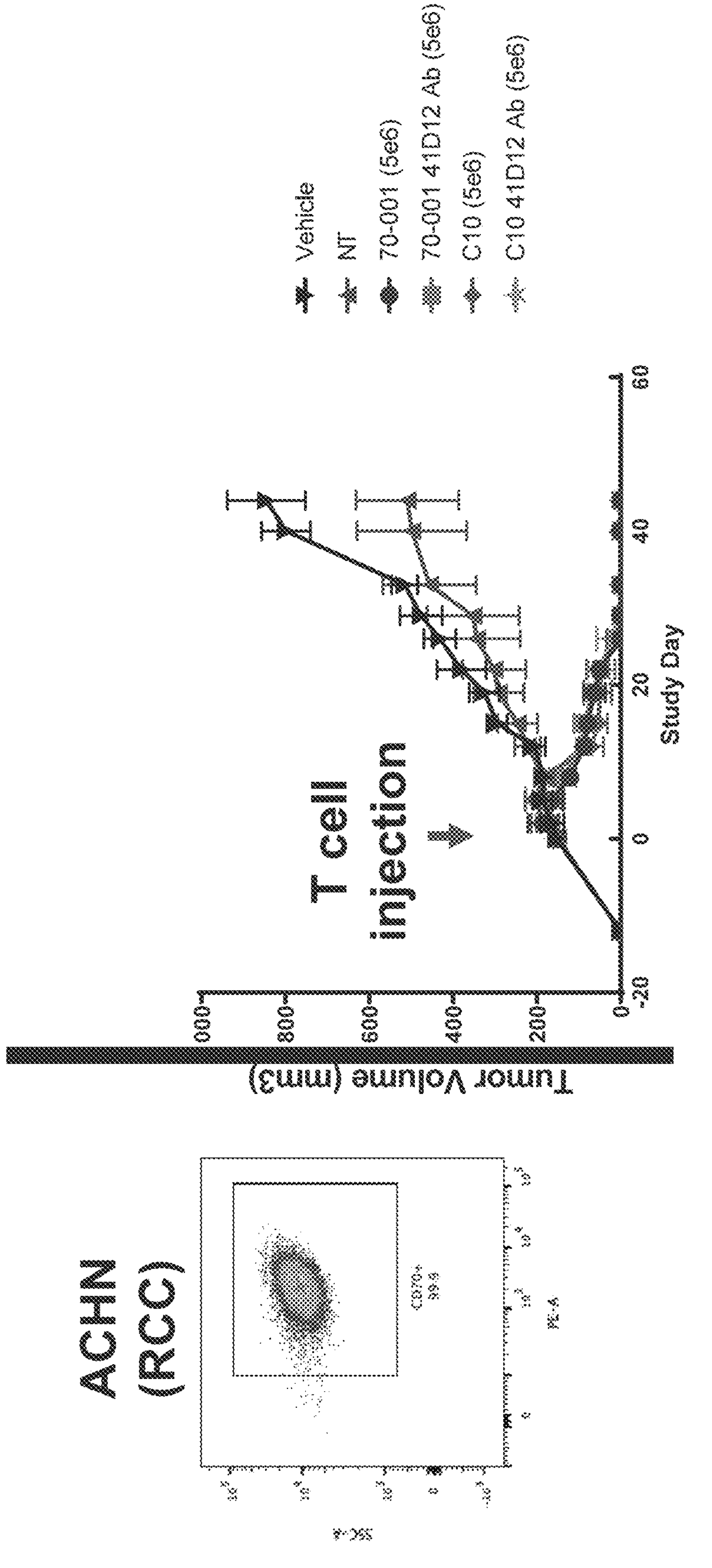
FIG. 75 is a graph showing tumor volume of mice treated with CD70 TFP+ T cells generated according to the methods described in Example 21 in the presence and absence of anti-CD70 antibody in a murine model of Renal Cell Carcinoma (ACHN).

As is shown in FIG. 75, mice treated with 70-001 CD70 TFP T cells or C10 CD70 TFP cells, generated in the presence or absence of 41D12 antibody, dramatically reduced tumor volume relative to untransduced T cells.

OTHER EMBODIMENTS

The disclosure set forth above may encompass multiple distinct inventions with independent utility. Although each of these inventions has been disclosed in its preferred form(s), the specific embodiments thereof as disclosed and illustrated herein are not to be considered in a limiting sense, because numerous variations are possible. The subject matter of the inventions includes all novel and nonobvious combinations and subcombinations of the various elements, features, functions, and/or properties disclosed herein. The following claims particularly point out certain combinations and subcombinations regarded as novel and nonobvious. Inventions embodied in other combinations and subcombinations of features, functions, elements, and/or properties may be claimed in this application, in applications claiming priority from this application, or in related applications. Such claims, whether directed to a different invention or to the same invention, and whether broader, narrower, equal, or different in scope in comparison to the original claims, also are regarded as included within the subject matter of the inventions of the present disclosure.

EXEMPLARY EMBODIMENTS

The following are illustrative examples of aspects and combination of aspects of the foregoing embodiments and examples:

1. A recombinant nucleic acid molecule comprising a sequence encoding a T cell receptor (TCR) fusion protein (TFP) wherein the TFP comprises:
   (a) a TCR subunit comprising:
      (i) at least a portion of a TCR extracellular domain, and
      (ii) a TCR transmembrane domain,
      (iii) a TCR intracellular domain, and
   (b) an antigen binding domain that specifically binds CD70; and
   wherein the TCR subunit and the antigen binding domain are operatively linked.
2. The recombinant nucleic acid molecule of embodiment 1, wherein the TFP functionally interacts with an endogenous TCR complex when expressed in a T cell.
3. The recombinant nucleic acid molecule of embodiments 1 or 2, wherein the TCR intracellular domain comprises a stimulatory domain from an intracellular signaling domain of CD3 gamma, CD3 delta, or CD3 epsilon.
4. The recombinant nucleic acid molecule of any one of embodiments 1-3, wherein a T cell expressing the TFP exhibits increased cytotoxicity to a human cell expressing CD70 compared to a T cell not containing the TFP.
5. The recombinant nucleic acid molecule of any one of embodiments 1-4, wherein the antigen binding domain is connected to the TCR extracellular domain by a linker sequence.
6. The recombinant nucleic acid molecule of embodiment 5, wherein the linker is 120 amino acids in length or less.
7. The recombinant nucleic acid molecule of embodiment 5, wherein the linker sequence comprises $(G_4S)_n$, wherein G is glycine, S is serine, and n is an integer from 1 to 10.
8. The recombinant nucleic acid molecule of embodiment 7, wherein n is an integer from 1 to 4.
9. The recombinant nucleic acid molecule of any one of embodiments 1-8, wherein at least two of the TCR extracellular domain, the TCR transmembrane domain, and the TCR intracellular domain are from the same TCR subunit.
10. The recombinant nucleic acid molecule of embodiment 9, wherein at least two of the TCR extracellular domain, the TCR transmembrane domain, and the TCR intracellular domain are from TCR alpha.
11. The recombinant nucleic acid molecule of embodiment 9, wherein at least two of the TCR extracellular domain, the TCR transmembrane domain, and the TCR intracellular domain are from TCR beta.
12. The recombinant nucleic acid molecule of embodiment 9, wherein at least two of the TCR extracellular domain, the TCR transmembrane domain, and the TCR intracellular domain are from TCR gamma.
13. The recombinant nucleic acid molecule of embodiment 9, wherein at least two of the TCR extracellular domain, the TCR transmembrane domain, and the TCR intracellular domain are from TCR delta.
14. The recombinant nucleic acid molecule of embodiment 9, wherein at least two of the TCR extracellular domain, the TCR transmembrane domain, and the TCR intracellular domain are from CD3 epsilon.
15. The recombinant nucleic acid molecule of embodiment 9, wherein at least two of the TCR extracellular domain, the TCR transmembrane domain, and the TCR intracellular domain are from CD3 delta.
16. The recombinant nucleic acid molecule of embodiment 9, wherein at least two of the TCR extracellular domain, the TCR transmembrane domain, and the TCR intracellular domain are from CD3 gamma.
17. The recombinant nucleic acid molecule of any one of embodiments 9-16, wherein all three of the TCR extracellular domain, the TCR transmembrane domain, and the TCR intracellular domain are from the same TCR subunit.
18. The recombinant nucleic acid molecule of any one of embodiments 1-17, wherein the antigen binding domain is a camelid antibody or binding fragment thereof.
19. The recombinant nucleic acid molecule of any one of embodiments 1-17, wherein the antigen binding domain is a murine antibody or binding fragment thereof.
20. The recombinant nucleic acid molecule of any one of embodiments 1-17, wherein the antigen binding domain is a human or humanized antibody or binding fragment thereof.
21. The recombinant nucleic acid molecule of any one of embodiments 1-20, wherein the antigen binding domain is a single-chain variable fragment (scFv) or a single domain antibody (sdAb) domain.
22. The recombinant nucleic acid molecule of any one of embodiments 1-21, wherein the antigen binding domain is a single domain antibody (sdAb).
23. The recombinant nucleic acid molecule of embodiment 22, wherein the sdAb is a $V_{HH}$.
24. The recombinant nucleic acid molecule of any one of embodiments 1-23, wherein the antigen binding domain binds to human CD70 with a $K_D$ value of 100 nM or less or from about 0.001 nM to about 100 nM.

25. The recombinant nucleic acid molecule of any one of embodiments 1-24, wherein the antigen binding domain does not compete with CD27 for binding to CD70, does not inhibit CD70 from interacting with CD27, and/or does not bind to the same epitope of CD70 to which CD27 binds.

26. The recombinant nucleic acid molecule of any one of embodiments 1-24, wherein the antigen binding domain competes with CD27 for binding to CD70, inhibits CD70 from interacting with CD27, and/or binds to the same epitope of CD70 to which CD27 binds.

27. The recombinant nucleic acid molecule of any one of embodiments 1-26, wherein the antigen binding domain comprises a variable domain comprising a complementarity determining region 1 (CDR1), a CDR2, and a CDR3.

28. The recombinant nucleic acid molecule of embodiment 27, wherein the CDR1, CDR2, and CDR3 are selected from the group consisting of:

(vii) a CDR1 comprising a sequence of $X_1X_2FX_3IX_4RGX_5$;
a CDR2 comprising a sequence of $AIX_6TSGX_7ATX_8YA$; and
a CDR3 comprising a sequence of $CNMEX_{11}X_{12}X_{13}YRX_{14}YW$;

(viii) a CDR1 comprising a sequence of $X_{15}X_{16}X_{17}X_{18}X_{19}YX_{20}X_{21}X_{22}$:
a CDR2 comprising a sequence of $X_{23}CX_{24}X_{25}SX_{26}X_{27}X_{28}X_{29}X_{30}KYA$; and
a CDR3 comprising a sequence of $CX_{31}AAX_{32}PX_{33}DDCSVX_{34}GX_{35}YGLNYW$;

(ix) a CDR1 comprising a sequence of $X_{36}TFDAYAIG$;
a CDR2 comprising a sequence of ICLSPSDG-STYYA; and
a CDR3 comprising a sequence of $CAX_{37}PSWCSLKADFGSW$;

(x) a CDR1 comprising a sequence of SIIRDNVMA;
a CDR2 comprising a sequence of $AIINX_{38}GGSX_{39}NVD$; and
a CDR3 comprising a sequence of $CNVYYRX_{40}LW$;

(xi) a CDR1 comprising a sequence of SIFSIARMN or FTLDYYAIA;
a CDR2 comprising a sequence of AILN-RAGRTDYA; and
a CDR3 comprising a sequence of CNLQTI-SYHDFW; and (xii) a CDR1 comprising a sequence of SIFSATRME;
a CDR2 comprising a sequence of AIVTSG-GRTNYA; and
a CDR3 comprising a sequence of CKFER-YDYVNYW;

wherein $X_1$—$X_{39}$ are any naturally occurring amino acid.

29. The recombinant nucleic acid molecule of embodiment 28, wherein:

(i) $X_4$ is a non-polar amino acid;
(ii) $X_5$ is a polar amino acid;
(iii) $X_6$ is a non-polar amino acid;
(iv) $X_{11}$ is a polar amino acid;
(v) $X_{12}$ is a non-polar amino acid;
(vi) $X_{11}$ is a polar amino acid;
(vii) $X_{18}$ is a negatively charged amino acid;
(viii) $X_{21}$ is a non-polar amino acid;
(ix) $X_{24}$ is a non-polar amino acid;
(x) $X_{25}$ is a polar amino acid;
(xi) $X_{29}$ is a non-polar amino acid; and/or
(xii) $X_{39}$ is a non-polar amino acid.

30. The recombinant nucleic acid molecule of embodiment 28 or 29, wherein:

(i) a CDR1 comprises a sequence of $X_1X_2FX_3IX_4RGX_5$,
wherein $X_1$ is S or G; $X_2$ is I or T; $X_3$ is D or G; $X_4$ is V or A; and $X_5$ is S or N;
a CDR2 comprises a sequence of $AIX_6TSGX_7ATX_8YA$,
wherein $X_8$ is I or V; $X_9$ is G or D; and $X_{10}$ is N or D; and
a CDR3 comprises a sequence of $CNMEX_{11}X_{12}X_{13}YRX_{14}YW$,
wherein $Xn_{11}$ is S or T; $X_{12}$ is F, V, or L; $X_{13}$ is R or S; and $X_{14}$ is N or H;

(ii) a CDR1 comprises a sequence of $X_{15}X_{16}X_{17}X_{18}X_{19}YX_{20}X_{21}X_{22}$,
wherein $X_{15}$ is F, L, or R; $X_{16}$ is T, S, or N; $X_{17}$ is L, F, or R; $X_{19}$ is D or E; $X_{19}$ is R, H,
Y, K, N; $X_{20}$ is S, A, or T; $X_{21}$ is I, V, or M; and $X_{22}$ is G or N;
a CDR2 comprises a sequence of $X_{23}CX_{24}X_{25}SX_{26}X_{27}X_{28}X_{29}X_{30}KYA$,
wherein $X_{23}$ is S, A, T, or L; $X_{24}$ is I or V; $X_{25}$ is S or T; $X_{26}$ is S, K, or N; $X_{17}$ is G or S;
$X_{28}$ is G or D; $X_{29}$ is I, L, or V; and $X_{30}$ is P, T, I, or V; and
a CDR3 comprises a sequence of $CX_{31}AAX_{32}PX_{33}DDCSVX_{34}GX_{35}YGLNYW$,
wherein $X_{31}$ is G, T, or A; $X_{32}$ is T, G, or D; $X_{33}$ is D, P, A, or K; $X_{34}$ is P, A, or H; and $X_{35}$ is H or Y;

(iii) a CDR1 comprises a sequence of $X_{36}TFDAYAIG$,
wherein $X_{36}$ is F or H;
a CDR2 comprising a sequence of ICLSPSDG-STYYA; and
a CDR3 comprising a sequence of $CAX_{37}PSWCSLKADFGSW$,
wherein $X_{37}$ is T or A; or (iv) a CDR1 comprises a sequence of SIIRDNVMA;
a CDR2 comprises a sequence of $AIINX_{38}GGSX_{39}NVD$,
wherein $X_{38}$ is T or I; and $X_{39}$ is A or G; and
a CDR3 comprises a sequence of $CNVYYRX_{40}LW$,
wherein $X_{40}$ is D or G.

31. The recombinant nucleic acid molecule of any one of embodiments 1-30, wherein the antigen binding domain comprises a variable domain having at least 90% sequence identity to any one of SEQ ID NOs: 603-620 or 622-688.

32. The recombinant nucleic acid molecule of embodiment 31, wherein the variable domain has at least 95% sequence identity to any one of SEQ ID NOs: 603-620 or 622-688.

33. The recombinant nucleic acid molecule of embodiment 32, wherein the variable domain comprises the sequence of any one of SEQ ID NOs: 603-620 or 622-688.

34. The recombinant nucleic acid molecule of embodiment 33, wherein the variable domain comprises the sequence of SEQ ID NO: 605.

35. The recombinant nucleic acid molecule of embodiment 33, wherein the variable domain comprises the sequence of SEQ ID NO: 611.

36. The recombinant nucleic acid molecule of embodiment 33, wherein the variable domain comprises the sequence of SEQ ID NO: 613.
37. The recombinant nucleic acid molecule of embodiment 33, wherein the variable domain comprises the sequence of SEQ ID NO: 620.
38. The recombinant nucleic acid molecule of embodiment 33, wherein the variable domain comprises the sequence of SEQ ID NO: 618.
39. The recombinant nucleic acid molecule of embodiment 33, wherein the variable domain comprises the sequence of SEQ ID NO: 603.
40. The recombinant nucleic acid molecule of embodiment 33, wherein the variable domain comprises the sequence of SEQ ID NO: 615.
41. The recombinant nucleic acid molecule of embodiment 33, wherein the variable domain comprises the sequence of SEQ ID NO: 608.
42. The recombinant nucleic acid molecule of embodiment 33, wherein the variable domain comprises the sequence of SEQ ID NO: 610.
43. The recombinant nucleic acid molecule of any one of embodiments 28-42, wherein
   (i) CDR1 comprises a sequence of any one of SEQ ID NOs: 87-104 or 107-172;
   (ii) CDR2 comprises a sequence of any one of SEQ ID NOs: 259-276 or 279-344; and
   (iii) CDR3 comprises a sequence of any one of SEQ ID NOs: 431-448 or 451-516.
44. The recombinant nucleic acid molecule of any one of embodiments 28-43, wherein CDR1 is SEQ ID NO: 89, CDR2 is SEQ ID NO: 261 and CDR3 is SEQ ID NO: 433.
45. The recombinant nucleic acid molecule of any one of embodiments 28-43, wherein CDR1 is SEQ ID NO: 95, CDR2 is SEQ ID NO: 267 and CDR3 is SEQ ID NO: 439.
46. The recombinant nucleic acid molecule of any one of embodiments 28-43, wherein CDR1 is SEQ ID NO: 97, CDR2 is SEQ ID NO: 269 and CDR3 is SEQ ID NO: 441.
47. The recombinant nucleic acid molecule of any one of embodiments 28-43, wherein CDR1 is SEQ ID NO: 104, CDR2 is SEQ ID NO: 276 and CDR3 is SEQ ID NO: 448.
48. The recombinant nucleic acid molecule of any one of embodiments 28-43, wherein CDR1 is SEQ ID NO: 102, CDR2 is SEQ ID NO: 274 and CDR3 is SEQ ID NO: 446.
49. The recombinant nucleic acid molecule of any one of embodiments 28-43, wherein CDR1 is SEQ ID NO: 87, CDR2 is SEQ ID NO: 259 and CDR3 is SEQ ID NO: 431.
50. The recombinant nucleic acid molecule of any one of embodiments 28-43, wherein CDR1 is SEQ ID NO: 99, CDR2 is SEQ ID NO: 271 and CDR3 is SEQ ID NO: 443.
51. The recombinant nucleic acid molecule of any one of embodiments 28-43, wherein CDR1 is SEQ ID NO: 92, CDR2 is SEQ ID NO: 264 and CDR3 is SEQ ID NO: 436.
52. The recombinant nucleic acid molecule of any one of embodiments 28-43, wherein CDR1 is SEQ ID NO: 94, CDR2 is SEQ ID NO: 266 and CDR3 is SEQ ID NO: 439.
53. The recombinant nucleic acid molecule of any one of embodiments 1-28, wherein the antigen binding domain comprises a variable domain having at least 90% sequence identity to SEQ ID NO: 621.
54. The recombinant nucleic acid molecule of embodiment 53, wherein the variable domain has at least 95% sequence identity to SEQ ID NO: 621.
55. The recombinant nucleic acid molecule of embodiment 54, wherein the variable domain comprises the sequence of SEQ ID NOs: 621.
56. The recombinant nucleic acid molecule of any one of embodiments 28 or 53-55, wherein CDR1 is SEQ ID NO: 105, CDR2 is SEQ ID NO: 227 and CDR3 is SEQ ID NO: 449.
57. The recombinant nucleic acid molecule of any one of embodiments 1-21, wherein the antigen binding domain is a single-chain variable fragment (scFv).
58. The recombinant nucleic acid molecule of embodiment 57, wherein the scFv comprises a heavy chain variable (VH) domain having at least 90% sequence identity to any one of SEQ ID NOs: 783-835.
59. The recombinant nucleic acid molecule of embodiment 57, wherein the scFv comprises a heavy chain variable (VH) domain having at least 95% sequence identity to any one of SEQ ID NOs: 783-835.
60. The recombinant nucleic acid molecule of embodiment 57, wherein the scFv comprises a heavy chain variable (VH) domain having a sequence of any one of SEQ ID NOs: 783-835.
61. The recombinant nucleic acid molecule of any one of embodiments 57-60, wherein the scFv comprises a light chain variable (VL) domain having at least 90% sequence identity to any one of SEQ ID NOs: 995-1047.
62. The recombinant nucleic acid molecule of any one of embodiments 57-60, wherein the scFv comprises a light chain variable (VL) domain having at least 95% sequence identity to any one of SEQ ID NOs: 995-1047.
63. The recombinant nucleic acid molecule of any one of embodiments 57-60, wherein the scFv comprises a light chain variable (VL) domain having a sequence of any one of SEQ ID NOs: 995-1047.
64. The recombinant nucleic acid molecule of any one of embodiments 58-63, wherein the VH domain comprises a heavy chain complementary determining region 1 (CDRH1) having a sequence of any one of SEQ ID NOs: 836-888, a CDRH2 having a sequence of any one of SEQ ID NOs: 889-941, and a CDRH3 having a sequence of any one of SEQ ID NOs: 942-994.
65. The recombinant nucleic acid molecule of any one of embodiments 58-64, wherein the VL domain comprises a light chain complementary determining region 1 (CDRL1) having a sequence of any one of SEQ ID NOs: 1048-1100, a CDRL2 having a sequence of any one of SEQ ID NOs: 1101-1153, and a CDRL3 having a sequence of any one of SEQ ID NOs: 1154-1206.
66. The recombinant nucleic acid molecule of any one of embodiments 57-65, wherein the scFv comprises a VH domain having at least 90% sequence identity to SEQ ID NO: 800.
67. The recombinant nucleic acid molecule of any one of embodiments 57-65, wherein the scFv comprises a VH domain having at least 95% sequence identity to SEQ ID NO: 800.
68. The recombinant nucleic acid molecule of any one of embodiments 57-65, wherein the scFv comprises a VH domain having a sequence of SEQ ID NO: 800.

69. The recombinant nucleic acid molecule of any one of embodiments 66-68, wherein the scFv comprises a VL domain having at least 90% sequence identity to SEQ ID NO: 1012.
70. The recombinant nucleic acid molecule of any one of embodiments 66-68, wherein the scFv comprises a VL domain having at least 95% sequence identity to SEQ ID NO: 1012.
71. The recombinant nucleic acid molecule of any one of embodiments 66-68, wherein the scFv comprises a VL domain having a sequence of SEQ ID NO: 1012.
72. The recombinant nucleic acid molecule of any one of embodiments 66-71, wherein the VH domain comprises a CDRH1 having a sequence of SEQ ID NO: 853, a CDRH2 having a sequence of SEQ ID NO: 906, and a CDRH3 having a sequence of SEQ ID NO: 959.
73. The recombinant nucleic acid molecule of any one of embodiments 66-72, wherein the VL domain comprises a CDRL1 having a sequence of SEQ ID NO: 1065, a CDRL2 having a sequence of SEQ ID NO: 1118, and a CDRL3 having a sequence of SEQ ID NO: 1171.
74. The recombinant nucleic acid molecule of any one of embodiments 57-65, wherein the scFv comprises a VH domain having at least 90% sequence identity to SEQ ID NO: 783.
75. The recombinant nucleic acid molecule of any one of embodiments 57-65, wherein the scFv comprises a VH domain having at least 95% sequence identity to SEQ ID NO: 783.
76. The recombinant nucleic acid molecule of any one of embodiments 57-65, wherein the scFv comprises a VH domain having a sequence of SEQ ID NO: 783.
77. The recombinant nucleic acid molecule of any one of embodiments 74-76, wherein the scFv comprises a VL domain having at least 90% sequence identity to SEQ ID NO: 995.
78. The recombinant nucleic acid molecule of any one of embodiments 74-76, wherein the scFv comprises a VL domain having at least 95% sequence identity to SEQ ID NO: 995.
79. The recombinant nucleic acid molecule of any one of embodiments 74-76, wherein the scFv comprises a VL domain having a sequence of SEQ ID NO: 995.
80. The recombinant nucleic acid molecule of any one of embodiments 74-79, wherein the VH domain comprises a CDRH1 having a sequence of SEQ ID NO: 836, a CDRH2 having a sequence of SEQ ID NO: 889, and a CDRH3 having a sequence of SEQ ID NO: 942.
81. The recombinant nucleic acid molecule of any one of embodiments 74-80, wherein the VL domain comprises a CDRL1 having a sequence of SEQ ID NO: 1048, a CDRL2 having a sequence of SEQ ID NO: 1101, and a CDRL3 having a sequence of SEQ ID NO: 1154.
82. The recombinant nucleic acid molecule of any one of embodiments 57-65, wherein the scFv comprises a VH domain having at least 90% sequence identity to SEQ ID NO: 784.
83. The recombinant nucleic acid molecule of any one of embodiments 57-65, wherein the scFv comprises a VH domain having at least 95% sequence identity to SEQ ID NO: 784.
84. The recombinant nucleic acid molecule of any one of embodiments 57-65, wherein the scFv comprises a VH domain having a sequence of SEQ ID NO: 784.
85. The recombinant nucleic acid molecule of any one of embodiments 82-84, wherein the scFv comprises a VL domain having at least 90% sequence identity to SEQ ID NO: 996.
86. The recombinant nucleic acid molecule of any one of embodiments 82-84, wherein the scFv comprises a VL domain having at least 95% sequence identity to SEQ ID NO: 996.
87. The recombinant nucleic acid molecule of any one of embodiments 82-84, wherein the scFv comprises a VL domain having a sequence of SEQ ID NO: 996.
88. The recombinant nucleic acid molecule of any one of embodiments 82-87, wherein the VH domain comprises a CDRH1 having a sequence of SEQ ID NO: 837, a CDRH2 having a sequence of SEQ ID NO: 890, and a CDRH3 having a sequence of SEQ ID NO: 943.
89. The recombinant nucleic acid molecule of any one of embodiments 82-88, wherein the VL domain comprises a CDRL1 having a sequence of SEQ ID NO: 1049, a CDRL2 having a sequence of SEQ ID NO: 1102, and a CDRL3 having a sequence of SEQ ID NO: 1155.
90. The recombinant nucleic acid molecule of any one of embodiments 57-89, wherein the scFv comprises a linker sequence of SEQ ID NO: 782.
91. The recombinant nucleic acid molecule of any one of embodiments 1-90, wherein a T cell expressing the TFP inhibits tumor growth when expressed in a T cell.
92. The recombinant nucleic acid molecule of any one of embodiments 1-90, wherein a T cell expressing the TFP has increased fratricide relative to a TFP having a different antigen binding domain.
93. The recombinant nucleic acid molecule of any one of embodiments 1-90, wherein a T cell expressing the TFP has decreased fratricide relative to a TFP having a different antigen binding domain.
94. A recombinant nucleic acid molecule comprising a sequence encoding an antibody or fragment thereof that specifically binds CD70.
95. The recombinant nucleic acid molecule of embodiment 94, wherein the antibody or antibody fragment is a camelid antibody or binding fragment thereof.
96. The recombinant nucleic acid molecule of embodiment 94, wherein the antibody or antibody fragment is a murine, human or humanized antibody or binding fragment thereof.
97. The recombinant nucleic acid molecule of any one of embodiments 94-96, wherein the antibody or antibody fragment is a single-chain variable fragment (scFv) or a single domain antibody (sdAb) domain.
98. The recombinant nucleic acid molecule of embodiment 97, wherein the antibody or antibody fragment is a single domain antibody (sdAb).
99. The recombinant nucleic acid molecule of embodiment 98, wherein the sdAb is a $V_{HH}$.
100. The recombinant nucleic acid molecule of any one of embodiments 94-99, wherein the antibody or antibody fragment binds to human CD70 with a $K_D$ value of 100 nM or less or from about 0.001 nM to about 100 nM.
101. The recombinant nucleic acid molecule of any one of embodiments 94-100, wherein the antibody or antibody fragment does not compete with CD27 for binding to CD70, does not inhibit CD70 from interacting with CD27, and/or does not bind to the same epitope of CD70 to which CD27 binds.
102. The recombinant nucleic acid molecule of any one of embodiments 94-100, wherein the antibody or antibody fragment competes with CD27 for binding to CD70, inhibits CD70 from interacting with CD27, and/or binds to the same epitope of CD70 to which CD27 binds 103. The recombinant nucleic acid molecule of any one of embodiments 94-102, wherein the antibody or antibody fragment comprises a variable domain comprising a complementarity determining region 1 (CDR1), a CDR2, and a CDR3.

104. The recombinant nucleic acid molecule of embodiment 103, wherein CDR1, CDR2, and CDR3 selected from the group consisting of:

(i) a CDR1 comprising a sequence of $X_1X_2FX_3IX_4RGX_5$;
a CDR2 comprising a sequence of $AIX_6TSGX_7ATX_8YA$; and
a CDR3 comprising a sequence of $CNMEX_{11}X_{12}X_{13}YRX_{14}YW$;

(ii) a CDR1 comprising a sequence of $X_{15}X_{16}X_{17}X_{18}X_{19}YX_{20}X_{21}X_{22}$:
a CDR2 comprising a sequence of $X_{23}CX_{24}X_{25}SX_{26}X_{27}X_{28}X_{29}X_{30}KYA$; and
a CDR3 comprising a sequence of $CX_{31}AAX_{32}PX_{33}DDCSVX_{34}GX_{35}YGLNYW$;

(iii) a CDR1 comprising a sequence of $X_{36}TFDAYAIG$;
a CDR2 comprising a sequence of ICLSPSDGSTYYA; and
a CDR3 comprising a sequence of $CAX_{37}PSWCSLKADFGSW$;

(iv) a CDR1 comprising a sequence of SIIRDNVMA;
a CDR2 comprising a sequence of $AIINX_{38}GGSX_{39}NVD$; and
a CDR3 comprising a sequence of $CNVYYRX_{40}LW$;

(v) a CDR1 comprising a sequence of SIFSIARMN or FTLDYYAIA;
a CDR2 comprising a sequence of AILNRAGRTDYA; and
a CDR3 comprising a sequence of CNLQTISYHDFW; and (vi) a CDR1 comprising a sequence of SIFSATRME;
a CDR2 comprising a sequence of AIVTSGGRTNYA; and
a CDR3 comprising a sequence of CKFERYDYVNYW;

wherein $X_1$—$X_{39}$ are any naturally occurring amino acid.

105. The recombinant nucleic acid molecule of embodiment 104, wherein:

(i) $X_4$ is a non-polar amino acid;
(ii) $X_5$ is a polar amino acid;
(iii) $X_6$ is a non-polar amino acid;
(iv) $X_{11}$ is a polar amino acid;
(v) $X_{12}$ is a non-polar amino acid;
(vi) $X_{16}$ is a polar amino acid;
(vii) $X_{18}$ is a negatively charged amino acid;
(viii) $X_{21}$ is a non-polar amino acid;
(ix) $X_{24}$ is a non-polar amino acid;
(x) $X_{25}$ is a polar amino acid;
(xi) $X_{29}$ is a non-polar amino acid; and/or
(xii) $X_{39}$ is a non-polar amino acid.

106. The recombinant nucleic acid molecule of embodiment 104 or 105, wherein:

(i) a CDR1 comprises a sequence of $X_1X_2FX_3IX_4RGX_5$,
wherein $X_1$ is S or G; $X_2$ is I or T; $X_3$ is D or G; $X_4$ is V or A; and $X_5$ is S or N;
a CDR2 comprises a sequence of $AIX_6TSGX_7ATX_8YA$,
wherein $X_8$ is I or V; $X_9$ is G or D; and $X_{10}$ is N or D; and
a CDR3 comprises a sequence of $CNMEX_{11}X_{12}X_{13}YRX_{14}YW$,
wherein $Xn_{11}$ is S or T; $X_{12}$ is F, V, or L; $X_{13}$ is R or S; and $X_{14}$ is N or H;

(ii) a CDR1 comprises a sequence of $X_{15}X_{16}X_{17}X_{18}X_{19}YX_{20}X_{21}X_{22}$,
wherein $X_{15}$ is F, L, or R; $X_{16}$ is T, S, or N; $X_{17}$ is L, F, or R; $X_{18}$ is D or E; $X_{19}$ is R, H,
Y, K, N; $X_{20}$ is S, A, or T; $X_{21}$ is I, V, or M; and $X_{22}$ is G or N;
a CDR2 comprises a sequence of $X_{23}CX_{24}X_{25}SX_{26}X_{27}X_{28}X_{29}X_{30}KYA$,
wherein $X_{23}$ is S, A, T, or L; $X_{24}$ is I or V; $X_{25}$ is S or T; $X_{26}$ is S, K, or N; $X_{17}$ is G or S;
$X_{28}$ is G or D; $X_{29}$ is I, L, or V; and $X_{30}$ is P, T, I, or V; and
a CDR3 comprises a sequence of $CX_{31}AAX_{32}PX_{33}DDCSVX_{34}GX_{35}YGLNYW$,
wherein $X_{31}$ is G, T, or A; $X_{32}$ is T, G, or D; $X_{33}$ is D, P, A, or K; $X_{34}$ is P, A, or H; and
$X_{35}$ is H or Y;

(iii) a CDR1 comprises a sequence of $X_{36}TFDAYAIG$, wherein $X_{36}$ is F or H;
a CDR2 comprising a sequence of ICLSPSDGSTYYA; and
a CDR3 comprising a sequence of $CAX_{37}PSWCSLKADFGSW$,
wherein $X_{37}$ is T or A; or (iv) a CDR1 comprises a sequence of SIIRDNVMA;
a CDR2 comprises a sequence of $AIINX_{38}GGSX_{39}NVD$,
wherein $X_{39}$ is T or I; and $X_{39}$ is A or G; and
a CDR3 comprises a sequence of $CNVYYRX_{40}LW$,
wherein $X_{40}$ is D or G.

107. The recombinant nucleic acid molecule of any one of embodiments 94-106, wherein the antibody or antibody fragment comprises a variable domain having at least 90% sequence identity to any one of SEQ ID NOs: 603-620 or 622-688.

108. The recombinant nucleic acid molecule of embodiment 107, wherein the variable domain has at least 95% sequence identity to any one of SEQ ID NOs: 603-620 or 622-688.

109. The recombinant nucleic acid molecule of embodiment 108, wherein the variable domain comprises the sequence of any one of SEQ ID NOs: 603-620 or 622-688.

110. The recombinant nucleic acid molecule of embodiment 109, wherein the variable domain comprises the sequence of SEQ ID NO: 605.

111. The recombinant nucleic acid molecule of embodiment 109, wherein the variable domain comprises the sequence of SEQ ID NO: 611.

112. The recombinant nucleic acid molecule of embodiment 109, wherein the variable domain comprises the sequence of SEQ ID NO: 613.

113. The recombinant nucleic acid molecule of embodiment 109, wherein the variable domain comprises the sequence of SEQ ID NO: 620.

114. The recombinant nucleic acid molecule of embodiment 109, wherein the variable domain comprises the sequence of SEQ ID NO: 618.

115. The recombinant nucleic acid molecule of embodiment 109, wherein the variable domain comprises the sequence of SEQ ID NO: 603.

116. The recombinant nucleic acid molecule of embodiment 109, wherein the variable domain comprises the sequence of SEQ ID NO: 615.

117. The recombinant nucleic acid molecule of embodiment 109, wherein the variable domain comprises the sequence of SEQ ID NO: 608.

118. The recombinant nucleic acid molecule of embodiment 109, wherein the variable domain comprises the sequence of SEQ ID NO: 610.

119. The recombinant nucleic acid molecule of any one of embodiments 104-118, wherein (i) CDR1 comprises a sequence of any one of SEQ ID NOs: 87-104 or 107-172;

(ii) CDR2 comprises a sequence of any one of SEQ ID NOs: 259-276 or 279-344; and (iii) CDR3 comprises a sequence of any one of SEQ ID NOs: 431-448 or 451-516.

120. The recombinant nucleic acid molecule of any one of embodiments 104-119, wherein CDR1 is SEQ ID NO: 89, CDR2 is SEQ ID NO: 261 and CDR3 is SEQ ID NO: 433.

121. The recombinant nucleic acid molecule of any one of embodiments 104-119, wherein CDR1 is SEQ ID NO: 95, CDR2 is SEQ ID NO: 267 and CDR3 is SEQ ID NO: 439.

122. The recombinant nucleic acid molecule of any one of embodiments 104-119, wherein CDR1 is SEQ ID NO: 97, CDR2 is SEQ ID NO: 269 and CDR3 is SEQ ID NO: 441.

123. The recombinant nucleic acid molecule of any one of embodiments 104-119, wherein CDR1 is SEQ ID NO: 104, CDR2 is SEQ ID NO: 276 and CDR3 is SEQ ID NO: 448.

124. The recombinant nucleic acid molecule of any one of embodiments 104-119, wherein CDR1 is SEQ ID NO: 102, CDR2 is SEQ ID NO: 274 and CDR3 is SEQ ID NO: 446.

125. The recombinant nucleic acid molecule of any one of embodiments 104-119, wherein CDR1 is SEQ ID NO: 87, CDR2 is SEQ ID NO: 259 and CDR3 is SEQ ID NO: 431.

126. The recombinant nucleic acid molecule of any one of embodiments 104-119, wherein CDR1 is SEQ ID NO: 99, CDR2 is SEQ ID NO: 271 and CDR3 is SEQ ID NO: 443.

127. The recombinant nucleic acid molecule of any one of embodiments 104-119, wherein CDR1 is SEQ ID NO: 92, CDR2 is SEQ ID NO: 264 and CDR3 is SEQ ID NO: 436.

128. The recombinant nucleic acid molecule of any one of embodiments 104-119, wherein CDR1 is SEQ ID NO: 94, CDR2 is SEQ ID NO: 266 and CDR3 is SEQ ID NO: 439.

129. The recombinant nucleic acid molecule of any one of embodiments 94-97, wherein the antibody or antibody fragment is a single-chain variable fragment (scFv).

130. The recombinant nucleic acid molecule of embodiment 129, wherein the scFv comprises a heavy chain variable (VH) domain having at least 90% sequence identity to any one of SEQ ID NOs: 783-835.

131. The recombinant nucleic acid molecule of embodiment 129, wherein the scFv comprises a heavy chain variable (VH) domain having at least 95% sequence identity to any one of SEQ ID NOs: 783-835.

132. The recombinant nucleic acid molecule of embodiment 129, wherein the scFv comprises a heavy chain variable (VH) domain having a sequence of any one of SEQ ID NOs: 783-835.

133. The recombinant nucleic acid molecule of any one of embodiments 129-132, wherein the scFv comprises a light chain variable (VL) domain having at least 90% sequence identity to any one of SEQ ID NOs: 995-1047.

134. The recombinant nucleic acid molecule of any one of embodiments 129-132, wherein the scFv comprises a light chain variable (VL) domain having at least 95% sequence identity to any one of SEQ ID NOs: 995-1047.

135. The recombinant nucleic acid molecule of any one of embodiments 129-132, wherein the scFv comprises a light chain variable (VL) domain having a sequence of any one of SEQ ID NOs: 995-1047.

136. The recombinant nucleic acid molecule of any one of embodiments 130-135, wherein the VH domain comprises a heavy chain complementary determining region 1 (CDRH1) having a sequence of any one of SEQ ID NOs: 836-888, a CDRH2 having a sequence of any one of SEQ ID NOs: 889-941, and a CDRH3 having a sequence of any one of SEQ ID NOs: 942-994.

137. The recombinant nucleic acid molecule of any one of embodiments 130-136, wherein the VL domain comprises a light chain complementary determining region 1 (CDRL1) having a sequence of any one of SEQ ID NOs: 1048-1100, a CDRL2 having a sequence of any one of SEQ ID NOs: 1101-1153, and a CDRL3 having a sequence of any one of SEQ ID NOs: 1154-1206.

138. The recombinant nucleic acid molecule of any one of embodiments 129-137, wherein the scFv comprises a VH domain having at least 90% sequence identity to SEQ ID NO: 800.

139. The recombinant nucleic acid molecule of any one of embodiments 129-137, wherein the scFv comprises a VH domain having at least 95% sequence identity to SEQ ID NO: 800.

140. The recombinant nucleic acid molecule of any one of embodiments 129-137, wherein the scFv comprises a VH domain having a sequence of SEQ ID NO: 800.

141. The recombinant nucleic acid molecule of any one of embodiments 138-140, wherein the scFv comprises a VL domain having at least 90% sequence identity to SEQ ID NO: 1012.

142. The recombinant nucleic acid molecule of any one of embodiments 138-140, wherein the scFv comprises a VL domain having at least 95% sequence identity to SEQ ID NO: 1012.

143. The recombinant nucleic acid molecule of any one of embodiments 138-140, wherein the scFv comprises a VL domain having a sequence of SEQ ID NO: 1012.

144. The recombinant nucleic acid molecule of any one of embodiments 138-143, wherein the VH domain comprises a CDRH1 having a sequence of SEQ ID NO: 853, a CDRH2 having a sequence of SEQ ID NO: 906, and a CDRH3 having a sequence of SEQ ID NO: 959.

145. The recombinant nucleic acid molecule of any one of embodiments 138-144, wherein the VL domain comprises a CDRL1 having a sequence of SEQ ID NO: 1065, a CDRL2 having a sequence of SEQ ID NO: 1118, and a CDRL3 having a sequence of SEQ ID NO: 1171.

146. The recombinant nucleic acid molecule of any one of embodiments 129-137, wherein the scFv comprises a VH domain having at least 90% sequence identity to SEQ ID NO: 783.
147. The recombinant nucleic acid molecule of any one of embodiments 129-137, wherein the scFv comprises a VH domain having at least 95% sequence identity to SEQ ID NO: 783.
148. The recombinant nucleic acid molecule of any one of embodiments 129-137, wherein the scFv comprises a VH domain having a sequence of SEQ ID NO: 783.
149. The recombinant nucleic acid molecule of any one of embodiments 146-148, wherein the scFv comprises a VL domain having at least 90% sequence identity to SEQ ID NO: 995.
150. The recombinant nucleic acid molecule of any one of embodiments 146-148, wherein the scFv comprises a VL domain having at least 95% sequence identity to SEQ ID NO: 995.
151. The recombinant nucleic acid molecule of any one of embodiments 146-148, wherein the scFv comprises a VL domain having a sequence of SEQ ID NO: 995.
152. The recombinant nucleic acid molecule of any one of embodiments 146-151, wherein the VH domain comprises a CDRH1 having a sequence of SEQ ID NO: 836, a CDRH2 having a sequence of SEQ ID NO: 889, and a CDRH3 having a sequence of SEQ ID NO: 942.
153. The recombinant nucleic acid molecule of any one of embodiments 146-152, wherein the VL domain comprises a CDRL1 having a sequence of SEQ ID NO: 1048, a CDRL2 having a sequence of SEQ ID NO: 1101, and a CDRL3 having a sequence of SEQ ID NO: 1154.
154. The recombinant nucleic acid molecule of any one of embodiments 129-137, wherein the scFv comprises a VH domain having at least 90% sequence identity to SEQ ID NO: 784.
155. The recombinant nucleic acid molecule of any one of embodiments 129-137, wherein the scFv comprises a VH domain having at least 95% sequence identity to SEQ ID NO: 784.
156. The recombinant nucleic acid molecule of any one of embodiments 129-137, wherein the scFv comprises a VH domain having a sequence of SEQ ID NO: 784.
157. The recombinant nucleic acid molecule of any one of embodiments 154-156, wherein the scFv comprises a VL domain having at least 90% sequence identity to SEQ ID NO: 996.
158. The recombinant nucleic acid molecule of any one of embodiments 154-156, wherein the scFv comprises a VL domain having at least 95% sequence identity to SEQ ID NO: 996.
159. The recombinant nucleic acid molecule of any one of embodiments 154-156, wherein the scFv comprises a VL domain having a sequence of SEQ ID NO: 996.
160. The recombinant nucleic acid molecule of any one of embodiments 154-159, wherein the VH domain comprises a CDRH1 having a sequence of SEQ ID NO: 837, a CDRH2 having a sequence of SEQ ID NO: 890, and a CDRH3 having a sequence of SEQ ID NO: 943.
161. The recombinant nucleic acid molecule of any one of embodiments 154-160, wherein the VL domain comprises a CDRL1 having a sequence of SEQ ID NO: 1049, a CDRL2 having a sequence of SEQ ID NO: 1102, and a CDRL3 having a sequence of SEQ ID NO: 1155.
162. The recombinant nucleic acid molecule of any one of embodiments 129-161, wherein the scFv comprises a linker sequence of SEQ ID NO: 782.
163. The recombinant nucleic acid molecule of any one of embodiments 94-162, wherein the recombinant nucleic acid molecule further comprises a sequence encoding a TCR constant domain.
164. The recombinant nucleic acid molecule of embodiment 163, wherein the antibody or antibody fragment is operatively linked to the sequence encoding a TCR constant domain, thereby forming a TFP.
165. The recombinant nucleic acid molecule of embodiment 163 or 164, wherein the TCR constant domain is a TCR alpha constant domain or portion thereof, a TCR beta constant domain or portion thereof, a TCR alpha constant domain or portion thereof and a TCR beta constant domain or portion thereof, a TCR gamma constant domain or portion thereof, a TCR delta constant domain or portion thereof, or a TCR gamma constant domain or portion thereof and a TCR delta constant domain or portion thereof.
166. The recombinant nucleic acid molecule of any one of embodiments 94-165, further comprising a leader sequence.
167. The recombinant nucleic acid molecule of any one of embodiments 1-166, wherein the nucleic acid is selected from the group consisting of a DNA and an RNA.
168. The recombinant nucleic acid molecule of embodiment 167, wherein the nucleic acid is a mRNA.
169. The recombinant nucleic acid molecule of embodiment 167, wherein the nucleic acid is a circRNA.
170. The recombinant nucleic acid molecule of any one of embodiments 1-169, wherein the nucleic acid comprises a nucleotide analog.
171. The recombinant nucleic acid molecule of embodiment 170, wherein the nucleotide analog is selected from the group consisting of 2'-O-methyl, 2'-O-methoxyethyl (2'-O-MOE), 2'-O-aminopropyl, 2'-deoxy, T-deoxy-2'-fluoro, 2'-O-aminopropyl (2'-O-AP), 2'-O-dimethylaminoethyl (2'-O-DMAOE), 2'-O-dimethylaminopropyl (2'-O-DMAP), T-O-dimethylaminoethyloxyethyl (2'-O-DMAEOE), 2'-O—N-methylacetamido (2'-O-NMA) modified, a locked nucleic acid (LNA), an ethylene nucleic acid (ENA), a peptide nucleic acid (PNA), a 1',5'-anhydrohexitol nucleic acid (HNA), a morpholino, a methylphosphonate nucleotide, a thiolphosphonate nucleotide, and a 2'-fluoro N3-P5'-phosphoramidite.
172. The recombinant nucleic acid molecule of any one of embodiments 1-171, further comprising a promoter.
173. The recombinant nucleic acid molecule of any one of embodiments 1-172, wherein the nucleic acid is an in vitro transcribed nucleic acid.
174. The recombinant nucleic acid molecule of any one of embodiments 1-173, wherein the nucleic acid further comprises a sequence encoding a poly(A) tail.
175. The recombinant nucleic acid molecule of any one of embodiments 1-174, wherein the nucleic acid further comprises a 3'UTR sequence.
176. A polypeptide encoded by the recombinant nucleic acid molecule of any one of embodiments 1-175.
177. A vector comprising a recombinant nucleic acid molecule encoding the TFP of any one of embodiments 1-93, 164, or 165.

178. A vector comprising a recombinant nucleic acid molecule encoding the antibody or antigen binding fragment of embodiments 94-163.
179. The vector of embodiment 177, further comprising a sequence encoding an siRNA, an shRNA, or an miRNA for reducing endogenous levels of CD70.
180. The vector of embodiment 177, further comprising a sequence encoding an inhibitory molecule that comprises a first polypeptide that comprises at least a portion of an inhibitory molecule, associated with a second polypeptide that comprises a positive signal from an intracellular signaling domain.
181. The vector of embodiment 177, further comprising a sequence encoding a TCR constant domain.
182. The vector of embodiment 181, wherein the TCR constant domain is a TCR alpha constant domain or portion thereof, a TCR beta constant domain or portion thereof, a TCR alpha constant domain or portion thereof and a TCR beta constant domain or portion thereof, a TCR gamma constant domain or portion thereof, a TCR delta constant domain or portion thereof, or a TCR gamma constant domain or portion thereof and a TCR delta constant domain or portion thereof.
183. The vector of any one of embodiments 177-182, wherein the vector is selected from the group consisting of a DNA, a RNA, a plasmid, a lentivirus vector, adenoviral vector, a Rous sarcoma viral (RSV) vector, or a retrovirus vector.
184. The vector of any one of embodiments 177-183, further comprising a promoter.
185. The vector of any one of embodiments 177-184, wherein the vector is an in vitro transcribed vector.
186. The vector of any one of embodiments 177-185, wherein a nucleic acid sequence in the vector further comprises a poly(A) tail.
187. The vector of any one of embodiments 177-186, wherein a nucleic acid sequence in the vector further comprises a 3'UTR.
188. A cell comprising the recombinant nucleic acid molecule of any one of embodiments 1-175, the polypeptide of embodiment 176, or the vector of any one of embodiments 177-187.
189. The cell of embodiment 188, wherein the cell is a T cell.
190. The T cell of embodiment 189, wherein the T cell is a human T cell.
191. The T cell of embodiment 189 or 190, wherein the T cell is a CD8+ or CD4+ T cell.
192. The T cell of embodiment 189, wherein the T cell is a human αβ T cell.
193. The T cell of embodiment 189, wherein the T cell is a human γδ T cell.
194. The cell of embodiment 188, wherein the cell is a human NKT cell.
195. The cell of any one of embodiments 188-194, wherein the cell comprises a functional disruption of an endogenous TCR.
196. The cell of any one of embodiments 188-195, wherein the cell is an allogeneic cell.
197. The cell of any one of embodiments 188-196, wherein the cell comprises a functional disruption of the endogenous CD70 gene.
198. The cell of any one of embodiments 188-196, wherein the cell comprises a functional disruption of the endogenous CIITA gene.
199. The cell of any one of embodiments 188-196, wherein the cell further comprises an antisense siRNA, an shRNA, or an miRNA for reducing endogenous levels of CD70.
200. The cell of any one of embodiments 188-196, wherein the cell further comprises an antisense siRNA, an shRNA, or an miRNA for reducing endogenous levels of CIITA.
201. The cell of any one of embodiments 188-196, wherein the cell further comprises a sequence encoding a fusion protein comprising an anti-CD70 antibody domain and an ER retention domain.
202. The cell of embodiment 201, wherein the recombinant nucleic acid comprises the sequence encoding the fusion protein.
203. The cell of embodiment 202, wherein the sequence encoding the TFP and the sequence encoding the fusion protein are contained in the same operon.
204. The cell of any one of embodiments 201-203, wherein the ER retention domain is encoded by any one of SEQ ID NOs: 756-779.
205. The cell of any one of embodiments 201-204, wherein the sequence encoding the fusion protein further comprises a CD8 alpha transmembrane domain between the anti-CD70 antibody domain and the ER retention domain.
206. The cell of any one of embodiments 201-205, wherein the sequence encoding the fusion protein further comprises a sequence encoding a CD8 alpha signal peptide 5' to the sequence encoding the anti-CD70 antibody domain.
207. The cell of any one of embodiments 201-206, wherein the antibody domain comprises the anti-CD70 antibody of any one of embodiments 94-128.
208. The cell of any one of embodiments 188-196, wherein the cell comprises a cell-surface expressed CD70 bound to an anti-CD70 antibody.
209. The cell of embodiment 208, wherein the anti-CD70 antibody is the antibody or antigen binding fragment encoded by the recombinant nucleic acid of embodiments 94-128.
210. The cell of embodiment 208, wherein the anti-CD70 antibody has greater affinity for CD70 than the antibody or antigen binding fragment encoded by the recombinant nucleic acid of embodiments 94-163.
211. The cell of any one of embodiments 188-210, wherein the cell further comprises a heterologous sequence encoding an inhibitory molecule that comprises a first polypeptide that comprises at least a portion of an inhibitory molecule, associated with a second polypeptide that comprises a positive signal from an intracellular signaling domain.
212. The cell of any one of embodiments 188-211, wherein the cell further comprises a heterologous sequence encoding a TCR constant domain.
213. The cell of embodiment 212, wherein the TCR constant domain is a TCR alpha constant domain or portion thereof, a TCR beta constant domain or portion thereof, a TCR alpha constant domain or portion thereof and a TCR beta constant domain or portion thereof, a TCR gamma constant domain or portion thereof, a TCR delta constant domain or portion thereof, or a TCR gamma constant domain or portion thereof and a TCR delta constant domain or portion thereof.

214. A pharmaceutical composition comprising the cell of any one of embodiments 188-213 and a pharmaceutically acceptable carrier.

215. A method of producing the cell of embodiment 197, the method comprising:
  (i) disrupting an endogenous CD70 gene, thereby producing a cell containing a functional disruption of an endogenous CD70 gene; and
  (ii) transducing the cell containing the functional disruption of the endogenous CD70 gene with the recombinant nucleic acid of any one of embodiments 1-93, 164, or 165, or the vector of any one of embodiments 177 or 180-187.

216. The method of embodiment 215, wherein the disrupting comprises transducing the cell with a nuclease protein or a nucleic acid sequence encoding a nuclease protein that targets the endogenous CD70 gene.

217. The method of embodiment 215 or 216, wherein the method further comprises disrupting an endogenous TCR.

218. A method of producing the cell of embodiment 197, the method comprising transducing a cell comprising a disruption of an endogenous CD70 gene with the recombinant nucleic acid of any one of embodiments 1-93, 164 or 165, or the vector of any one of embodiments 177 or 180-187.

219. The method of embodiment 218, wherein the cell further comprises a disruption of an endogenous TCR.

220. A method of producing the cell of any one of embodiments 188-196 or 208-210, the method comprising:
  (i) transducing a cell with the recombinant nucleic acid of any one of embodiments 1-93, 164, or 165, or the vector of any one of embodiments 177 or 180-187; and
  (ii) contacting the cell with an anti-CD70 antibody that binds to CD70 on the cell surface.

221. The method of embodiment 220, wherein the anti-CD70 antibody is the antibody or antigen binding fragment encoded by the recombinant nucleic acid of embodiments 94-163.

222. The method of embodiment 220, wherein the anti-CD70 antibody has greater affinity for CD70 than the antibody or antigen binding fragment encoded by the recombinant nucleic acid of embodiments 94-163.

223. The method of any one of embodiments 220-222, wherein the contacting occurs prior to the transducing.

224. The method of embodiment 223, wherein the contacting occurs up to 1 day prior to the transducing.

225. The method of any one of embodiments 220-222, wherein the contacting occurs after the transducing.

226. The method of embodiment 225, wherein the contacting occurs up to 5 days after the transducing.

227. The method of any one of embodiments 220-226, further comprising sub-culturing the cells in media that does not comprise the anti-CD70 antibody 4 or more days after the transducing.

228. The method of embodiment 227, wherein the sub-culturing comprises sub-culturing the cells in media that does not comprise the anti-CD70 antibody 7 or more days after the transducing.

229. A method of treating a cancer in a subject in need thereof, comprising administering to the subject an effective amount of the pharmaceutical composition of embodiment 214.

230. A method of treating a cancer in a subject in need thereof, the method comprising administering to the subject a pharmaceutical composition comprising (a) the cell of any one of embodiments 188-213; and (b) a pharmaceutically acceptable carrier.

231. The method of embodiment 229 or 230, wherein the cancer is a cancer associated with elevated expression of CD70.

232. The method of any one of embodiments 229-231, further comprising administering to the subject an agent that increases levels of CD70 in the cancer cells.

233. The method of embodiment 232, wherein the agent that increases levels of CD70 is a hypomethylating agent.

234. The method of embodiment 233, wherein the hypomethylating agent is 5-azacitidine or decitabine.

235. The method of any one of embodiments 229-234, wherein the disease or the condition is selected from the group consisting of T cell lymphoma, diffuse large B-cell lymphoma (DLBCL), mantle cell lymphoma (MCL), acute myeloid leukemia (AML), myelodysplastic syndrome (MDS), an Epstein-Barr virus (EBV)+cancer, and/or a human papilloma virus (HPV)+cancer.

236. The method of any one of embodiments 229-234, wherein the disease or the condition is selected from the group consisting of kidney cancer, renal cell carcinoma, lung cancer, pancreatic cancer, ovarian cancer, esophageal cancer, nasopharyngeal carcinoma, mesothelioma, glioblastoma, thymic carcinoma, breast cancer, head and neck cancer, and gastric cancer.

237. The method of any one of embodiments 229-236, wherein the subject is a human.

238. A method of producing the cell of embodiment 198, the method comprising:
  (i) disrupting an endogenous CIITA gene, thereby producing a cell containing a functional disruption of an endogenous CIITA 0 gene; and
  (ii) transducing the cell containing the functional disruption of the endogenous CIITA gene with the recombinant nucleic acid of any one of embodiments 1-93, 164, or 165, or the vector of any one of embodiments 177 or 180-187.

239. The method of embodiment 238, wherein the disrupting comprises transducing the cell with a nuclease protein or a nucleic acid sequence encoding a nuclease protein that targets the endogenous CIITA gene.

240. The method of embodiment 238 or 239, wherein the method further comprises disrupting an endogenous TCR.

241. A method of producing the cell of embodiment 198, the method comprising transducing a cell comprising a disruption of an endogenous CIITA gene with the recombinant nucleic acid of any one of embodiments 1-93, 164 or 165, or the vector of any one of embodiments 177 or 180-187.

242. The method of embodiment 218, wherein the cell further comprises a disruption of an endogenous TCR.

243. A method of producing the cell of any one of embodiments 201-207, the method comprising transducing a cell with the recombinant nucleic acid of any one of embodiments 1-93, 164, or 165 or the vector of any one of embodiments 177 or 180-187 and a sequence encoding a fusion protein comprising an anti-CD70 antibody domain and an ER retention domain.

244. The method of embodiment 243, wherein the recombinant nucleic acid or vector and the sequence encoding the fusion protein are transduced simultaneously.

245. The method of embodiment 244, wherein the recombinant nucleic acid or vector comprises the sequence encoding the fusion protein.

246. The method of embodiment 245, wherein the sequence encoding the TFP and the sequence encoding the fusion protein are contained in the same operon.

247. The method of embodiment 243, wherein the recombinant nucleic acid or vector are transduced before or after the sequence encoding the fusion protein.

248. The method of any one of embodiments 243-247, wherein the ER retention domain is encoded by any one of SEQ ID NOs: 756-779.

249. The method of any one of embodiments 243-248, wherein the sequence encoding the fusion protein further comprises a CD8 alpha transmembrane domain between the anti-CD70 antibody domain and the ER retention domain.

250. The method of any one of embodiments 243-249, wherein the sequence encoding the fusion protein further comprises a sequence encoding a CD8 alpha signal peptide 5' to the sequence encoding the anti-CD70 antibody domain.

251. The method of any one of embodiments 243-250, wherein the antibody domain comprises the anti-CD70 antibody of any one of embodiments 94-128.

TABLE 5

Table of Exemplary Sequences

| TCR | Clono type | Component | SEQ ID NO: | Sequence |
|---|---|---|---|---|
| R3P2G8 | 1 | FW1 | 1 | QVQLQESGGGLVQTGGSLRLSCTASG |
| | | CDR1 | 87 | SIFDIARGN |
| | | FW2 | 173 | WYRQAPGKQRELV |
| | | CDR2 | 259 | AIITSGGATNYA |
| | | FW3 | 345 | DSVAGRFTISRDDAKNTVYLQMNGLKPEDTAVYF |
| | | CDR3 | 431 | CNMESLSYRHYW |
| | | FW4 | 517 | GQGTQVTVSS |
| | | VH AA | 603 | QVQLQESGGGLVQTGGSLRLSCTASGSIFDIARGNWYRQAPGKQRELVAIITSGGATNYADSVAGRFTISRDDAKNTVYLQMNGLKPEDTAVYFCNMESLSYRHYWGQGTQVTVSS |
| R3P3G1 | 1 | FW1 | 2 | QVQLQESGGGLVQTGGSLRLSCTASG |
| | | CDR1 | 88 | SIFDIARGN |
| | | FW2 | 174 | WYRQAPGKQRELV |
| | | CDR2 | 260 | AIITSGGATNYA |
| | | FW3 | 346 | DSVAGRFTISRDTAWKALYLQMNSLKPEDTAVYF |
| | | CDR3 | 432 | CNMESLSYRHYW |
| | | FW4 | 518 | GQGTQVTVSS |
| | | VH AA | 604 | QVQLQESGGGLVQTGGSLRLSCTASGSIFDIARGNWYRQAPGKQRELVAIITSGGATNYADSVAGRFTISRDTAWKALYLQMNSLKPEDTAVYFCNMESLSYRHYWGQGTQVTVSS |
| R3P3H12 | 1 | FW1 | 3 | QVQLQESGGGLVQTGGSLRLSCTASG |
| | | CDR1 | 89 | SIFDIVRGS |
| | | FW2 | 175 | WYRQAPGNQRELV |
| | | CDR2 | 261 | AIITSGGATNYA |
| | | FW3 | 347 | DSVAGRFTISRDSAWKALYLQMNSLKPEDTAVYF |

TABLE 5-continued

Table of Exemplary Sequences

| TCR | Clono type | Component | SEQ ID NO: | Sequence |
|---|---|---|---|---|
| | | CDR3 | 433 | CNMESVRYRNYW |
| | | FW4 | 519 | GQGTQVTVSS |
| | | VH AA | 605 | QVQLQESGGGLVQTGGSLRLSCTAS GSIFDIVRGSWYRQAPGNQRELVAI ITSGGATNYADSVAGRFTISRDSAW KALYLQMNSLKPEDTAVYFCNMESV RYRNYWGQGTQVTVSS |
| — | 1 | FW1 | 4 | QVQLQESGGGLVQTGGSLRLSCTAS G |
| | | CDR1 | 90 | STFDIARGN |
| | | FW2 | 176 | WYRQAPGKQRELV |
| | | CDR2 | 262 | AIITSGGATNYA |
| | | FW3 | 348 | DSVAGRFTISRDTAWKALYLQMNSL KPEDTAVYF |
| | | CDR3 | 434 | CNMESLSYRHYW |
| | | FW4 | 520 | GQGTQVTVSS |
| | | VH AA | 606 | QVQLQESGGGLVQTGGSLRLSCTAS GSTFDIARGNWYRQAPGKQRELVAI ITSGGATNYADSVAGRFTISRDTAW KALYLQMNSLKPEDTAVYFCNMESL SYRHYWGQGTQVTVSS |
| R3aP7F10 | 1 | FW1 | 5 | QVQLQESGGGLVQTGGSLRLSCTAS G |
| | | CDR1 | 91 | SIFDIARGN |
| | | FW2 | 177 | WYRQAPGKQRELV |
| | | CDR2 | 263 | AIITSGGATNYA |
| | | FW3 | 349 | DSVAGRFTISRDSAWKALYLQMNSL KPEDTAVYF |
| | | CDR3 | 435 | CNMETFSYRNYW |
| | | FW4 | 521 | GQGTQVTVSS |
| | | VH AA | 607 | QVQLQESGGGLVQTGGSLRLSCTAS GSIFDIARGNWYRQAPGKQRELVAI ITSGGATNYADSVAGRFTISRDSAW KALYLQMNSLKPEDTAVYFCNMETF SYRNYWGQGTQVTVSS |
| R2P14A12 | 2 | FW1 | 6 | QVQLQESGGGLVQPGGSLRLSCVAS G |
| | | CDR1 | 92 | FTLDRYAVG |
| | | FW2 | 178 | WFRQAPGKELEGV |
| | | CDR2 | 264 | SCISSSGDIIKYA |
| | | FW3 | 350 | DSAKGRFTIARDNAKNTAYLQMNSL KPEDTAVYY |
| | | CDR3 | 436 | CTAADPKDDCSVPGYYGLNYW |
| | | FW4 | 522 | GKGTQVTVSS |
| | | VH AA | 608 | QVQLQESGGGLVQPGGSLRLSCVAS GFTLDRYAVGWFRQAPGKELEGVSC ISSSGDIIKYADSAKGRFTIARDNA |

TABLE 5-continued

Table of Exemplary Sequences

| TCR | Clono type | Component | SEQ ID NO: | Sequence |
|---|---|---|---|---|
| | | | | KNTAYLQMNSLKPEDTAVYYCTAAD PKDDCSVPGYYGLNYWGKGTQVTVS S |
| R2P16E7 | 2 | FW1 | 7 | QVQLQESGGGLVQPGGSLRLSCVAS G |
| | | CDR1 | 93 | FTLDRYSVN |
| | | FW2 | 179 | WFRQAPGKEREGV |
| | | CDR2 | 265 | TCITSSGDIIKYA |
| | | FW3 | 351 | DSAKGRFTISRDNAKNTAYLEMNSL KPEDTAVYY |
| | | CDR3 | 437 | CAAAGPKDDCSVPGYYGLNYW |
| | | FW4 | 523 | GKGTQVTVSS |
| | | VH AA | 609 | QVQLQESGGGLVQPGGSLRLSCVAS GFTLDRYSVNWFRQAPGKEREGVTC ITSSGDIIKYADSAKGRFTISRDNA KNTAYLEMNSLKPEDTAVYYCAAAG PKDDCSVPGYYGLNYWGKGTQVTVS S |
| R3P15F6 | 2 | FW1 | 8 | QVQLQESGGGLVQPGGSLRLSCVAS G |
| | | CDR1 | 94 | FTLDKYAIG |
| | | FW2 | 180 | WFRQAPGKELEGV |
| | | CDR2 | 266 | SCITSSSGVVKYA |
| | | FW3 | 352 | DSVKGRFIISRDNTNNRAFLQMSSL KPEDTAVYY |
| | | CDR3 | 438 | CAAAGPPDDCSVPGYYGLNYW |
| | | FW4 | 524 | GKGTQVTVSS |
| | | VH AA | 610 | QVQLQESGGGLVQPGGSLRLSCVAS GFTLDKYAIGWFRQAPGKELEGVSC ITSSSGVVKYADSVKGRFIISRDNT NNRAFLQMSSLKPEDTAVYYCAAAG PPDDCSVPGYYGLNYWGKGTQVTVS S |
| R2P16D9 | 2 | FW1 | 9 | QVQLQESGGGLVQPGGSLRLSCAAS G |
| | | CDR1 | 95 | FTLEHYSIG |
| | | FW2 | 181 | WFRQAPGKDLEGV |
| | | CDR2 | 267 | SCITSSGGIPKYA |
| | | FW3 | 353 | DSVKGRFIISRDNAKNTGYLQMNSL KPEDTAVYY |
| | | CDR3 | 439 | CGAATPDDDCSVPGHYGLNYW |
| | | FW4 | 525 | GKGTQVTVSS |
| | | VH AA | 611 | QVQLQESGGGLVQPGGSLRLSCAAS GFTLEHYSIGWFRQAPGKDLEGVSC ITSSGGIPKYADSVKGRFIISRDNA KNTGYLQMNSLKPEDTAVYYCGAAT PDDDCSVPGHYGLNYWGKGTQVTVS S |

TABLE 5-continued

| Table of Exemplary Sequences | | | | |
|---|---|---|---|---|
| TCR | Clono type | Component | SEQ ID NO: | Sequence |
| — | 2 | FW1 | 10 | QVQLQESGGGLVQPGGSLRLSCTASD |
| | | CDR1 | 96 | FNLERYAIN |
| | | FW2 | 182 | WFRQAPGKEREGV |
| | | CDR2 | 268 | LCITSSGGITKYA |
| | | FW3 | 354 | NSVKGRFIISRDNTKNRAYLQMNSLKPEDTAVYY |
| | | CDR3 | 440 | CAAAGPPDDCSVPGYYGLNYW |
| | | FW4 | 526 | GKGTQVTVSS |
| | | VH AA | 612 | QVQLQESGGGLVQPGGSLRLSCTASDFNLERYAINWFRQAPGKEREGVLCITSSGGITKYANSVKGRFIISRDNTKNRAYLQMNSLKPEDTAVYYCAAAGPPDDCSVPGYYGLNYWGKGTQVTVSS |
| R3aP9D10 | 3 | FW1 | 11 | QVQLQESGGGLVQAGGSLRLSCAAPG |
| | | CDR1 | 97 | FTFDAYAIG |
| | | FW2 | 183 | WFRQAPGKEREGV |
| | | CDR2 | 269 | ICLSPSDGSTYYA |
| | | FW3 | 355 | DSVKGRFTISSDNAKNTVYLQMNSLKPEDTAVYY |
| | | CDR3 | 441 | CATPSWCSLKADFGSW |
| | | FW4 | 527 | GQGTQVTVSS |
| | | VH AA | 613 | QVQLQESGGGLVQAGGSLRLSCAAPGFTFDAYAIGWFRQAPGKEREGVICLSPSDGSTYYADSVKGRFTISSDNAKNTVYLQMNSLKPEDTAVYYCATPSWCSLKADFGSWGQGTQVTVSS |
| — | 3 | FW1 | 12 | QVQLQESGGGLVQTGGSLRLSCAASG |
| | | CDR1 | 98 | HTFDAYAIG |
| | | FW2 | 184 | WFRQAPGKEREGV |
| | | CDR2 | 270 | ICLSPSDGSTYYA |
| | | FW3 | 356 | DSVKGRFTISSDNAKNTVYLQMNSLKPEDTAVYY |
| | | CDR3 | 442 | CAAPSWCSLKADFGSW |
| | | FW4 | 528 | GQGTQVTVSS |
| | | VH AA | 614 | QVQLQESGGGLVQTGGSLRLSCAASGHTFDAYAIGWFRQAPGKEREGVICLSPSDGSTYYADSVKGRFTISSDNAKNTVYLQMNSLKPEDTAVYYCAAPSWCSLKADFGSWGQGTQVTVSS |
| R3aP4D6 | 4 | FW1 | 13 | QVQLQESGGGLVQAGGSLRLSCAASK |
| | | CDR1 | 99 | SIIRDNVMA |
| | | FW2 | 185 | WHRQAPGKQRELV |

TABLE 5-continued

| Table of Exemplary Sequences | | | | |
|---|---|---|---|---|
| TCR | Clono type | Component | SEQ ID NO: | Sequence |
| | | CDR2 | 271 | AIINTGGSANVD |
| | | FW3 | 357 | DSVKGRFTISRDNAKNMVYLQMNNL KPEDTAVYY |
| | | CDR3 | 443 | CNVYYRDLW |
| | | FW4 | 529 | GQGTQVTVSS |
| | | VH AA | 615 | QVQLQESGGGLVQAGGSLRLSCAAS KSIIRDNVMAWHRQAPGKQRELVAI INTGGSANVDDSVKGRFTISRDNAK NMVYLQMNNLKPEDTAVYYCNVYYR DLWGQGTQVTVSS |
| — | 4 | FW1 | 14 | QVQLQESGGGLVQPGGSLRLSCAAS K |
| | | CDR1 | 100 | SIIRDNVMA |
| | | FW2 | 186 | WHRQAPGKQRELV |
| | | CDR2 | 272 | AIINTGGSANVD |
| | | FW3 | 358 | DSVKGRFTISRDNAKNMVYLQMNNL KPEDTAVYY |
| | | CDR3 | 444 | CNVYYRDLW |
| | | FW4 | 530 | GQGTQVTVSS |
| | | VH AA | 616 | QVQLQESGGGLVQPGGSLRLSCAAS KSIIRDNVMAWHRQAPGKQRELVAI INTGGSANVDDSVKGRFTISRDNAK NMVYLQMNNLKPEDTAVYYCNVYYR DLWGQGTQVTVSS |
| — | 4 | FW1 | 15 | QVQLQESGGGLVQAGGSLRLSCAAS K |
| | | CDR1 | 101 | SIIRDNVMA |
| | | FW2 | 187 | WHRQAPGKQRELV |
| | | CDR2 | 273 | AIINTGGSANVD |
| | | FW3 | 359 | DSVKGRFTISRDNAKNMVYLQMNNL KPEDTAVYY |
| | | CDR3 | 445 | CNVYYRGLW |
| | | FW4 | 531 | GQGTQVTVSS |
| | | VH AA | 617 | QVQLQESGGGLVQAGGSLRLSCAAS KSIIRDNVMAWHRQAPGKQRELVAI INTGGSANVDDSVKGRFTISRDNAK NMVYLQMNNLKPEDTAVYYCNVYYR GLWGQGTQVTVSS |
| R3aP3E8 | 5 | FW1 | 16 | QVQLQESGGGLVQPGGSLRLSCVAS G |
| | | CDR1 | 102 | SIFSIARMN |
| | | FW2 | 188 | WYRQAPGKQRELV |
| | | CDR2 | 274 | AILNRAGRTDYA |
| | | FW3 | 360 | DSVKGRFTISSDNAKTTVYLQMNSL KPEDTALYY |
| | | CDR3 | 446 | CNLQTISYHDFW |

TABLE 5-continued

| Table of Exemplary Sequences | | | | |
|---|---|---|---|---|
| TCR | Clono type | Component | SEQ ID NO: | Sequence |
| | | FW4 | 532 | GQGTQVTVSS |
| | | VH AA | 618 | QVQLQESGGGLVQPGGSLRLSCVAS GSIFSIARMNWYRQAPGKQRELVAI LNRAGRTDYADSVKGRFTISSDNAK TTVYLQMNSLKPEDTALYYCNLQTI SYHDFWGQGTQVTVSS |
| — | 5 | FW1 | 17 | QVQLQESGGGLVQPGGSLRLSCAAS G |
| | | CDR1 | 103 | FTLDYYAIA |
| | | FW2 | 189 | WFRQAPGKQRELV |
| | | CDR2 | 275 | AILNRAGRTDYA |
| | | FW3 | 361 | DSVKGRFTISSDNAKTTVYLQMNSL KPEDTALYY |
| | | CDR3 | 447 | CNLQTISYHDFW |
| | | FW4 | 533 | GQGTQVTVSS |
| | | VH AA | 619 | QVQLQESGGGLVQPGGSLRLSCAAS GFTLDYYAIAWFRQAPGKQRELVAI LNRAGRTDYADSVKGRFTISSDNAK TTVYLQMNSLKPEDTALYYCNLQTI SYHDFWGQGTQVTVSS |
| R3P5A1 | 6 | FW1 | 18 | QVQLQESGGGLVQPGGSLRLSCTAS G |
| | | CDR1 | 104 | SIFSATRME |
| | | FW2 | 190 | WYRQAPGKQRELV |
| | | CDR2 | 276 | AIVTSGGRTNYA |
| | | FW3 | 362 | DSVNGRFTISRDNAKNTLYLQMNNL KPEDTAVYY |
| | | CDR3 | 448 | CKFERYDYVNYW |
| | | FW4 | 534 | GRGTQVTVSS |
| | | VH AA | 620 | QVQLQESGGGLVQPGGSLRLSCTAS GSIFSATRMEWYRQAPGKQRELVAI VTSGGRTNYADSVNGRFTISRDNAK NTLYLQMNNLKPEDTAVYYCKFERY DYVNYWGRGTQVTVSS |
| 1F6 | Control 1 | FW1 | 19 | QIQLVQSGPEVKKPGETVKISCKAS G |
| | | CDR1 | 105 | YTFTNYGMN |
| | | FW2 | 191 | WVKQAPGKGLKWM |
| | | CDR2 | 277 | GWINTYTGEPTYA |
| | | FW3 | 363 | DAFKGRFAFSLETSASTAYLQINNL KNEDTATYF |
| | | CDR3 | 449 | CARDYGDYGMDYW |
| | | FW4 | 535 | GQGTSVTVSS |
| | | VH AA | 621 | QIQLVQSGPEVKKPGETVKISCKAS GYTFTNYGMNWVKQAPGKGLKWMGW INTYTGEPTYADAFKGRFAFSLETS ASTAYLQINNLKNEDTATYFCARDY GDYGMDYWGQGTSVTVSS |

TABLE 5-continued

Table of Exemplary Sequences

| TCR | Clono type | Component | SEQ ID NO: | Sequence |
|---|---|---|---|---|
| 41D12 | Control 2 | FW1 | 20 | EVQLVESGGGLVQPGGSLRLSCAASG |
| | | CDR1 | 106 | FTFSVYYMN |
| | | FW2 | 192 | WVRQAPGKGLEWV |
| | | CDR2 | 278 | SDINNEGGTTYYA |
| | | FW3 | 364 | DSVKGRFTISRDNSKNSLYLQMNSLRAEDTAVYY |
| | | CDR3 | 450 | CARDAGYSNHVPIFDSW |
| | | FW4 | 536 | GQGTLVTVSS |
| | | VH AA | 622 | EVQLVESGGGLVQPGGSLRLSCAASGFTFSVYYMNWVRQAPGKGLEWVSDINNEGGTTYYADSVKGRFTISRDNSKNSLYLQMNSLRAEDTAVYYCARDAGYSNHVPIFDSWGQGTLVTVSS |
| 3HCDS109 | 1 | FW1 | 21 | QVQLQESGGGLVQPGGSLRLSCTASG |
| | | CDR1 | 107 | SIFDIARGN |
| | | FW2 | 193 | WYRQAPGKQRELV |
| | | CDR2 | 279 | AIITSGGATNYA |
| | | FW3 | 365 | DSVAGRFTISRDSAWKALYLQMNSLKPGDTAVYF |
| | | CDR3 | 451 | CNMETFSYRNYW |
| | | FW4 | 537 | GQGTQVTVSS |
| | | VH AA | 623 | QVQLQESGGGLVQPGGSLRLSCTASGSIFDIARGNWYRQAPGKQRELVAIITSGGATNYADSVAGRFTISRDSAWKALYLQMNSLKPGDTAVYFCNMETFSYRNYWGQGTQVTVSS |
| SID1R3aP10H6 | 1 | FW1 | 22 | QVQLQESGGGLVQPGGSLRLSCTASG |
| | | CDR1 | 108 | SIFDIARGN |
| | | FW2 | 194 | WYRQAPGKQRELV |
| | | CDR2 | 280 | AIITSGDATNYA |
| | | FW3 | 366 | DSVAGRFTISRDSAWKALYLQMNSLKPEDTAVYF |
| | | CDR3 | 452 | CNMETFSYRNYW |
| | | FW4 | 538 | GQGTQVTVSS |
| | | VH AA | 624 | QVQLQESGGGLVQPGGSLRLSCTASGSIFDIARGNWYRQAPGKQRELVAIITSGDATNYADSVAGRFTISRDSAWKALYLQMNSLKPEDTAVYFCNMETFSYRNYWGQGTQVTVSS |
| SID1R3aP6E5 | 1 | FW1 | 23 | QVQLQESGGGLVQPGGSLRLSCTASG |
| | | CDR1 | 109 | SIFDIARGN |
| | | FW2 | 195 | WYRQAPGKQRELV |
| | | CDR2 | 281 | AIITSGDATNYA |

TABLE 5-continued

Table of Exemplary Sequences

| TCR | Clono type | Component | SEQ ID NO: | Sequence |
|---|---|---|---|---|
| | | FW3 | 367 | DSVAGRFTISRDSAWKALYLQMNSL KPEDTAVYF |
| | | CDR3 | 453 | CNMETFSYRNYW |
| | | FW4 | 539 | GQGTQVTVSS |
| | | VH AA | 625 | QVQLQESGGGLVQPGGSLRLSCTAS GSIFDIARGNWYRQAPGKQRELVAI ITSGDATNYADSVAGRFTISRDSAW KALYLQMNSLKPEDTAVYFCNMETF SYRNYWGQGTQVTVSS |
| SID1R2P12A4 | 1 | FW1 | 24 | QVQLQESGGGLVQPGGSLRLSCTAS G |
| | | CDR1 | 110 | SIFDIARGN |
| | | FW2 | 196 | WYRQAPGKQRELV |
| | | CDR2 | 282 | AIITSGDATNYA |
| | | FW3 | 368 | DSVAGRFTISRDSAWKALYLQMNSL KPEDTAVYF |
| | | CDR3 | 454 | CNMETFSYRNYW |
| | | FW4 | 540 | GQGTQVTVSS |
| | | VH AA | 626 | QVQLQESGGGLVQPGGSLRLSCTAS GSIFDIARGNWYRQAPGKQRELVAI ITSGDATNYADSVAGRFTISRDSAW KALYLQMNSLKPEDTAVYFCNMETF SYRNYWGQGTQVTVSS |
| SID1R3aP8G1 | 1 | FW1 | 25 | QVQLQESGGGLVQPGGSLRLSCTAS G |
| | | CDR1 | 111 | SIFDIARGN |
| | | FW2 | 197 | WYRQAPGKQRELV |
| | | CDR2 | 283 | AIITSGGATDYA |
| | | FW3 | 369 | DSVAGRFTISRDSAWKALYLQMNSL KPEDTAVYF |
| | | CDR3 | 455 | CNMETFSYRNYW |
| | | FW4 | 541 | GQGTQVTVSS |
| | | VH AA | 627 | QVQLQESGGGLVQPGGSLRLSCTAS GSIFDIARGNWYRQAPGKQRELVAI ITSGGATDYADSVAGRFTISRDSAW KALYLQMNSLKPEDTAVYFCNMETF SYRNYWGQGTQVTVSS |
| SID1R3P8F1 | 1 | FW1 | 26 | QVQLQESGGGLVQPGGSLRLSCAAS G |
| | | CDR1 | 112 | SIFDIARGN |
| | | FW2 | 198 | WYRQAPGKQRELV |
| | | CDR2 | 284 | AIITSGGATNYA |
| | | FW3 | 370 | DSVAGRFTISRDSAWKALYLQMNSL KPEDTAVYF |
| | | CDR3 | 456 | CNMETFSYRNYW |
| | | FW4 | 542 | GQGTQVTVSS |

TABLE 5-continued

Table of Exemplary Sequences

| TCR | Clono type | Component | SEQ ID NO: | Sequence |
|---|---|---|---|---|
| | | VH AA | 628 | QVQLQESGGGLVQPGGSLRLSCAAS GSIFDIARGNWYRQAPGKQRELVAI ITSGGATNYADSVAGRFTISRDSAW KALYLQMNSLKPEDTAVYFCNMETF SYRNYWGQGTQVTVSS |
| SID1R2P3G2 | 1 | FW1 | 27 | QVQLQESGGGLVQTGGSLRLSCTAS G |
| | | CDR1 | 113 | SIFDIARGN |
| | | FW2 | 199 | WYRQAPGKQRELV |
| | | CDR2 | 285 | AIITSGGATNYA |
| | | FW3 | 371 | DPVAGRFTISRDSAWKALYLQMNSL KPEDTAVYF |
| | | CDR3 | 457 | CNMETFSYRNYW |
| | | FW4 | 543 | GQGTQVTVSS |
| | | VH AA | 629 | QVQLQESGGGLVQTGGSLRLSCTAS GSIFDIARGNWYRQAPGKQRELVAI ITSGGATNYADPVAGRFTISRDSAW KALYLQMNSLKPEDTAVYFCNMETF SYRNYWGQGTQVTVSS |
| SID1R2P20G2 | 1 | FW1 | 28 | QVQLQESGGGLVQTGGSLRLSCTAS G |
| | | CDR1 | 114 | SIFDIARGN |
| | | FW2 | 200 | WYRQAPGKQRELV |
| | | CDR2 | 286 | AIITSGGATNYA |
| | | FW3 | 372 | DSVAGRFAISRDSAWKALYLQMNSL KPEDTAVYF |
| | | CDR3 | 458 | CNMETFSYRNYW |
| | | FW4 | 544 | GQGTQVTVSS |
| | | VH AA | 630 | QVQLQESGGGLVQTGGSLRLSCTAS GSIFDIARGNWYRQAPGKQRELVAI ITSGGATNYADSVAGRFAISRDSAW KALYLQMNSLKPEDTAVYFCNMETF SYRNYWGQGTQVTVSS |
| SID1R3P11G12 | 1 | FW1 | 29 | QVQLQESGGGLVQTGGSLRLSCTAS G |
| | | CDR1 | 115 | SIFDIARGN |
| | | FW2 | 201 | WYRQAPGKQRELV |
| | | CDR2 | 287 | AHITSGGATNYA |
| | | FW3 | 373 | DSVAGRFTISRDSAWKALYLQMNSL KPEDTAVYF |
| | | CDR3 | 459 | CNMETFSYRNYW |
| | | FW4 | 545 | GQGTQVTVSS |
| | | VH AA | 631 | QVQLQESGGGLVQTGGSLRLSCTAS GSIFDIARGNWYRQAPGKQRELVAI ITSGGATNYADSVAGRFTISRDSAW KALYLQMNSLKPEDTAVYFCNMETF SYRNYWGQGTQVTVSS |
| SID1R3aP7F9 | 1 | FW1 | 30 | QVQLQESGGGLVQTGGSLRLSCTAS G |

TABLE 5-continued

| Table of Exemplary Sequences | | | | |
|---|---|---|---|---|
| TCR | Clono type | Component | SEQ ID NO: | Sequence |
| | | CDR1 | 116 | SIFDIARGN |
| | | FW2 | 202 | WYRQAPGKQRELV |
| | | CDR2 | 288 | AHITSGGATNYA |
| | | FW3 | 374 | DSVAGRFTISRDSARKALYLQMNSL KPEDTAVYF |
| | | CDR3 | 460 | CNMETFSYRNYW |
| | | FW4 | 546 | GQGTQVTVSS |
| | | VH AA | 632 | QVQLQESGGGLVQTGGSLRLSCTAS GSIFDIARGNWYRQAPGKQRELVAI ITSGGATNYADSVAGRFTISRDSAR KALYLQMNSLKPEDTAVYFCNMETF SYRNYWGQGTQVTVSS |
| 3HCDS151 | 1 | FW1 | 31 | QVQLQESGGGLVHAGGSLRLSCAVS G |
| | | CDR1 | 117 | SIFDIVRGS |
| | | FW2 | 203 | WYRQAPGNQRELV |
| | | CDR2 | 289 | AIITSGGATNYA |
| | | FW3 | 375 | DSVAGRFTISRDSAWKALYLQMNSL KPEDTAVYF |
| | | CDR3 | 461 | CNMESVRYRNYW |
| | | FW4 | 547 | GQGTQVTVSS |
| | | VH AA | 633 | QVQLQESGGGLVHAGGSLRLSCAVS GSIFDIVRGSWYRQAPGNQRELVAI ITSGGATNYADSVAGRFTISRDSAW KALYLQMNSLKPEDTAVYFCNMESV RYRNYWGQGTQVTVSS |
| 3HCDS168 | 1 | FW1 | 32 | QVQLQESGGGLVQSEGSLRLSCAAS G |
| | | CDR1 | 118 | SIFDIVRGS |
| | | FW2 | 204 | WYRQAPGNQRELV |
| | | CDR2 | 290 | AHITSGGATNYA |
| | | FW3 | 376 | DSVAGRFTISRDSAWKALYLQMNSL KPEDTAVYF |
| | | CDR3 | 462 | CNMESVRYRNYW |
| | | FW4 | 548 | GQGTQVTVSS |
| | | VH AA | 634 | QVQLQESGGGLVQSEGSLRLSCAAS GSIFDIVRGSWYRQAPGNQRELVAI ITSGGATNYADSVAGRFTISRDSAW KALYLQMNSLKPEDTAVYFCNMESV RYRNYWGQGTQVTVSS |
| SID1R3aP1A1 | 1 | FW1 | 33 | QVQLQESGGGLVQTGGSLRLSCTAS G |
| | | CDR1 | 119 | SIFDIVRGS |
| | | FW2 | 205 | WYRQAPGNQRELV |
| | | CDR2 | 291 | AIITSGGATNYA |

TABLE 5-continued

Table of Exemplary Sequences

| TCR | Clono type | Component | SEQ ID NO: | Sequence |
|---|---|---|---|---|
| | | FW3 | 377 | DSVAGRLTISRDSAWKALYLQMNSL KPEDTAVYF |
| | | CDR3 | 463 | CNMESVRYRNYW |
| | | FW4 | 549 | GQGTQVTVSS |
| | | VH AA | 635 | QVQLQESGGGLVQTGGSLRLSCTAS GSIFDIVRGSWYRQAPGNQRELVAI ITSGGATNYADSVAGRLTISRDSAW KALYLQMNSLKPEDTAVYFCNMESV RYRNYWGQGTQVTVSS |
| SID1R3aP2F5 | 1 | FW1 | 34 | QVQLQESGGGLVQTGGSLRLSCTAS G |
| | | CDR1 | 120 | SIFDIVRGS |
| | | FW2 | 206 | WYRQAPGNQRELV |
| | | CDR2 | 292 | AIITSGGATNYA |
| | | FW3 | 378 | DSVAGRFTISRDGAWKALYLQMNSL KPEDTAVYF |
| | | CDR3 | 464 | CNMESVRYRNYW |
| | | FW4 | 550 | GQGTQVTVSS |
| | | VH AA | 636 | QVQLQESGGGLVQTGGSLRLSCTAS GSIFDIVRGSWYRQAPGNQRELVAI ITSGGATNYADSVAGRFTISRDGAW KALYLQMNSLKPEDTAVYFCNMESV RYRNYWGQGTQVTVSS |
| SID1R3P1C5 | 1 | FW1 | 35 | QVQLQESGGGLVQTGGSLRLSCTAS G |
| | | CDR1 | 121 | SIFDIVRGS |
| | | FW2 | 207 | WYRQVPGNQRELV |
| | | CDR2 | 293 | AIITSGGATNYA |
| | | FW3 | 379 | DSVAGRFTISRDSAWKALYLQMNSL KPEDTAVYF |
| | | CDR3 | 465 | CNMESVRYRNYW |
| | | FW4 | 551 | GQGTQVTVSS |
| | | VH AA | 637 | QVQLQESGGGLVQTGGSLRLSCTAS GSIFDIVRGSWYRQVPGNQRELVAI ITSGGATNYADSVAGRFTISRDSAW KALYLQMNSLKPEDTAVYFCNMESV RYRNYWGQGTQVTVSS |
| 2HCDS48 | 1 | FW1 | 36 | QVQLQESGGGLVQTGGSLRLSCTVS G |
| | | CDR1 | 122 | SIFDIVRGS |
| | | FW2 | 208 | WYRQAPGNQRELV |
| | | CDR2 | 294 | AIITSGGATNYA |
| | | FW3 | 380 | DSVAGRFTISRDSAWKALYLQMNSL KPEDTAVYF |
| | | CDR3 | 466 | CNMESVRYRNYW |
| | | FW4 | 552 | GQGTQVTVSS |

TABLE 5-continued

| Table of Exemplary Sequences | | | | |
|---|---|---|---|---|
| TCR | Clono type | Component | SEQ ID NO: | Sequence |
| | | VH AA | 638 | QVQLQESGGGLVQTGGSLRLSCTVSGSIFDIVRGSWYRQAPGNQRELVAIITSGGATNYADSVAGRFTISRDSAWKALYLQMNSLKPEDTAVYFCNMESVRYRNYWGQGTQVTVSS |
| 3HCDS126 | 1 | FW1 | 37 | QVQLQESGGGLVQTGGSLRLSCTASG |
| | | CDR1 | 123 | SIFDIVRGS |
| | | FW2 | 209 | WYRQAPGNQRELV |
| | | CDR2 | 295 | AIITSGGATNYA |
| | | FW3 | 381 | DSVAGRFTISRDSAWKALYLQMNSLEPEDTAVYF |
| | | CDR3 | 467 | CNMESVRYRNYW |
| | | FW4 | 553 | GQGTQVTVSS |
| | | VH AA | 639 | QVQLQESGGGLVQTGGSLRLSCTASGSIFDIVRGSWYRQAPGNQRELVAIITSGGATNYADSVAGRFTISRDSAWKALYLQMNSLEPEDTAVYFCNMESVRYRNYWGQGTQVTVSS |
| —SID1R3aP5H5 | 1 | FW1 | 38 | QVQLQESGGGLVQTGGSLRLSCTASG |
| | | CDR1 | 124 | SIFDIVRGN |
| | | FW2 | 210 | WYRQAPGNQRELV |
| | | CDR2 | 296 | AIITSGGATNYA |
| | | FW3 | 382 | DSVAGRFTISRDSAWKALYLQMNSLKPEDTAVYF |
| | | CDR3 | 468 | CNMESVRYRNYW |
| | | FW4 | 554 | GQGTQVTVSS |
| | | VH AA | 640 | QVQLQESGGGLVQTGGSLRLSCTASGSIFDIVRGNWYRQAPGNQRELVAIITSGGATNYADSVAGRFTISRDSAWKALYLQMNSLKPEDTAVYFCNMESVRYRNYWGQGTQVTVSS |
| SID1R3P13G9 | 1 | FW1 | 39 | QVQLQESGGGLVQTGGSLRLSCTASG |
| | | CDR1 | 125 | SIFDIVRGN |
| | | FW2 | 211 | WYRQAPGNQRELV |
| | | CDR2 | 297 | AIITSGGATNYA |
| | | FW3 | 383 | DSVAGRFTISRDNAWKALYLQMNSLKPEDTAVYF |
| | | CDR3 | 469 | CNMESVRYRNYW |
| | | FW4 | 555 | GQGTQVTVSS |
| | | VH AA | 641 | QVQLQESGGGLVQTGGSLRLSCTASGSIFDIVRGNWYRQAPGNQRELVAIITSGGATNYADSVAGRFTISRDNAWKALYLQMNSLKPEDTAVYFCNMESVRYRNYWGQGTQVTVSS |
| SID1R3P6G3 | 1 | FW1 | 40 | QVQLQESGGGLVQAGGSLRLSCTASG |

TABLE 5-continued

| Table of Exemplary Sequences | | | | |
|---|---|---|---|---|
| TCR | Clono type | Component | SEQ ID NO: | Sequence |
| | | CDR1 | 126 | SIFDIVRGN |
| | | FW2 | 212 | WYRQAPGNQRELV |
| | | CDR2 | 298 | AIITSGGATNYA |
| | | FW3 | 384 | DSVAGRFTISRDSAWKALYLQMNSL KPEDTAVYF |
| | | CDR3 | 470 | CNMESVRYRNYW |
| | | FW4 | 556 | GQGTQVTVSS |
| | | VH AA | 642 | QVQLQESGGGLVQAGGSLRLSCTAS GSIFDIVRGNWYRQAPGNQRELVAI ITSGGATNYADSVAGRFTISRDSAW KALYLQMNSLKPEDTAVYFCNMESV RYRNYWGQGTQVTVSS |
| SID1R3P2C7 | 1 | FW1 | 41 | QVQLQESGGGLVQPGGSLRLSCTAS G |
| | | CDR1 | 127 | SIFDIVRGN |
| | | FW2 | 213 | WYRQAPGNQRELV |
| | | CDR2 | 299 | AIITSGGATNYA |
| | | FW3 | 385 | DSVAGRFTISRDNAWKALYLQMNSL KPEDTAVYF |
| | | CDR3 | 471 | CNMESVRYRNYW |
| | | FW4 | 557 | GQGTQVTVSS |
| | | VH AA | 643 | QVQLQESGGGLVQPGGSLRLSCTAS GSIFDIVRGNWYRQAPGNQRELVAI ITSGGATNYADSVAGRFTISRDNAW KALYLQMNSLKPEDTAVYFCNMESV RYRNYWGQGTQVTVSS |
| 3HCDS15 | 1 | FW1 | 42 | QVQLQESGGGLVQPGGSLRLSCTAS G |
| | | CDR1 | 128 | SIFDIVRGN |
| | | FW2 | 214 | WYRQAPGNQRELV |
| | | CDR2 | 300 | AIITSGGATNYA |
| | | FW3 | 386 | DSVAGRFTISRDSAWKALYLQMNSL KPEDTAVYF |
| | | CDR3 | 472 | CNMESVRYRNYW |
| | | FW4 | 558 | GQGTQVTVSS |
| | | VH AA | 644 | QVQLQESGGGLVQPGGSLRLSCTAS GSIFDIVRGNWYRQAPGNQRELVAI ITSGGATNYADSVAGRFTISRDSAW KALYLQMNSLKPEDTAVYFCNMESV RYRNYWGQGTQVTVSS |
| SID1R3aP5D4 | 1 | FW1 | 43 | QVQLQESGGGLVQPGGSLRLSCTAS G |
| | | CDR1 | 129 | SIFDIVRGN |
| | | FW2 | 215 | WYRQAPGNQRELV |

TABLE 5-continued

| Table of Exemplary Sequences | | | | |
|---|---|---|---|---|
| TCR | Clono type | Component | SEQ ID NO: | Sequence |
| | | CDR2 | 301 | AIITSGGATNYA |
| | | FW3 | 387 | DSVAGRFTISRDSAWKALYLQMNSL KPEDTAVYF |
| | | CDR3 | 473 | CNMESVRYRNYW |
| | | FW4 | 559 | GQGTQVTVSS |
| | | VH AA | 645 | QVQLQESGGGLVQPGGSLRLSCTAS GSIFDIVRGNWYRQAPGNQRELVAI ITSGGATNYADSVAGRFTISRDSAW KALYLQMNSLKPEDTAVYFCNMESV RYRNYWGQGTQVTVSS |
| 3HCDS100 | 1 | FW1 | 44 | QVQLQESGGGLVQPGGSLRLSCTAS G |
| | | CDR1 | 130 | SIFGIVRGS |
| | | FW2 | 216 | WYRQAPGNQRELV |
| | | CDR2 | 302 | AHITSGGATNYA |
| | | FW3 | 388 | DSVAGRFTISRDSAWKALYLQMNSL KPEDTAVYF |
| | | CDR3 | 474 | CNMESVRYRNYW |
| | | FW4 | 560 | GQGTQVTVSS |
| | | VH AA | 646 | QVQLQESGGGLVQPGGSLRLSCTAS GSIFGIVRGSWYRQAPGNQRELVAI ITSGGATNYADSVAGRFTISRDSAW KALYLQMNSLKPEDTAVYFCNMESV RYRNYWGQGTQVTVSS |
| 3HCDS106 | 1 | FW1 | 45 | QVQLQESGGGLAQPGGSLRLSCTAS G |
| | | CDR1 | 131 | SIFDIVRGS |
| | | FW2 | 217 | WYRQAPGNQRELV |
| | | CDR2 | 303 | AIITSGGATNYA |
| | | FW3 | 389 | DSVAGRFTISRDSAWKALYLQMNSL KPEDTAVYF |
| | | CDR3 | 475 | CNMESVRYRNYW |
| | | FW4 | 561 | GQGTQVTVSS |
| | | VH AA | 647 | QVQLQESGGGLAQPGGSLRLSCTAS GSIFDIVRGSWYRQAPGNQRELVAI ITSGGATNYADSVAGRFTISRDSAW KALYLQMNSLKPEDTAVYFCNMESV RYRNYWGQGTQVTVSS |
| SID1R3aP1E11 | 1 | FW1 | 46 | QVQLQESGGGLVQSGGSLRLSCTAS G |
| | | CDR1 | 132 | SIFDIVRGS |
| | | FW2 | 218 | WYRQAPGNQRELV |
| | | CDR2 | 304 | AHITSGGATNYA |
| | | FW3 | 390 | DSVAGRFTISRDSAWKALYLQMNSL KPEDTAVYF |
| | | CDR3 | 476 | CNMESVRYRNYW |

TABLE 5-continued

| Table of Exemplary Sequences | | | | |
|---|---|---|---|---|
| TCR | Clono type | Component | SEQ ID NO: | Sequence |
| | | FW4 | 562 | GQGTQVTVSS |
| | | VH AA | 648 | QVQLQESGGGLVQSGGSLRLSCTAS GSIFDIVRGSWYRQAPGNQRELVAI ITSGGATNYADSVAGRFTISRDSAW KALYLQMNSLKPEDTAVYFCNMESV RYRNYWGQGTQVTVSS |
| 3HCDS149 | 1 | FW1 | 47 | QVQLQESGGGLVQPGGSLRLSCTAS G |
| | | CDR1 | 133 | SIFDIVRGS |
| | | FW2 | 219 | WYRQAPGNQRELV |
| | | CDR2 | 305 | AIITSGGATNYA |
| | | FW3 | 391 | DSVAGRFTISRDSAWKALYLQMNSL KPEDTAVYF |
| | | CDR3 | 477 | CNMESVRYRNYW |
| | | FW4 | 563 | GQGTQVTVSS |
| | | VH AA | 649 | QVQLQESGGGLVQPGGSLRLSCTAS GSIFDIVRGSWYRQAPGNQRELVAI ITSGGATNYADSVAGRFTISRDSAW KALYLQMNSLKPEDTAVYFCNMESV RYRNYWGQGTQVTVSS |
| SID1R3aP2F1 | 1 | FW1 | 48 | QVQLQESGGGLVQTGGSLRLSCTAS G |
| | | CDR1 | 134 | GIFDIARGN |
| | | FW2 | 220 | WYRQAPGKQRELV |
| | | CDR2 | 306 | AHITSGGATNYA |
| | | FW3 | 392 | DSVAGRFTISRDTAWKALYLQMNSL KPEDTAVYF |
| | | CDR3 | 478 | CNMESLSYRHYW |
| | | FW4 | 564 | GQGTQVTVSS |
| | | VH AA | 650 | QVQLQESGGGLVQTGGSLRLSCTAS GGIFDIARGNWYRQAPGKQRELVAI ITSGGATNYADSVAGRFTISRDTAW KALYLQMNSLKPEDTAVYFCNMESL SYRHYWGQGTQVTVSS |
| SID1R3aP2D7 | 1 | FW1 | 49 | QVQLQESGGGLVQTGGSLRLSCTAS G |
| | | CDR1 | 135 | SIFGIARGN |
| | | FW2 | 221 | WYRQAPGKQRELV |
| | | CDR2 | 307 | AIITSGGATNYA |
| | | FW3 | 393 | DSVAGRFTISRDTAWKALYLQMNSL KPEDTAVYF |
| | | CDR3 | 479 | CNMESLSYRHYW |
| | | FW4 | 565 | GQGTQVTVSS |
| | | VH AA | 651 | QVQLQESGGGLVQTGGSLRLSCTAS GSIFGIARGNWYRQAPGKQRELVAI ITSGGATNYADSVAGRFTISRDTAW KALYLQMNSLKPEDTAVYFCNMESL SYRHYWGQGTQVTVSS |

TABLE 5-continued

| Table of Exemplary Sequences | | | | |
|---|---|---|---|---|
| TCR | Clono type | Component | SEQ ID NO: | Sequence |
| SID1R3P1A1 | 1 | FW1 | 50 | QVQLQESGGGLVQTGGSLRLSCTASG |
| | | CDR1 | 136 | SIFDIARGN |
| | | FW2 | 222 | WYRQAPGKQRELV |
| | | CDR2 | 308 | AIVTSGGATNYA |
| | | FW3 | 394 | DSVAGRFTISRDTAWKALYLQMNSLKPEDTAVYF |
| | | CDR3 | 480 | CNMESLSYRHYW |
| | | FW4 | 566 | GQGTQVTVSS |
| | | VH AA | 652 | QVQLQESGGGLVQTGGSLRLSCTASGSIFDIARGNWYRQAPGKQRELVAIVTSGGATNYADSVAGRFTISRDTAWKALYLQMNSLKPEDTAVYFCNMESLSYRHYWGQGTQVTVSS |
| SID1R3aP3D12 | 1 | FW1 | 51 | QVQLQESGGGLVQTGGSLRLSCTASG |
| | | CDR1 | 137 | SIFDIARGN |
| | | FW2 | 223 | WYRQAPGKQRELV |
| | | CDR2 | 309 | AIITSGGATNYA |
| | | FW3 | 395 | DSVAGRFTISRGTAWKALYLQMNSLKPEDTAVYF |
| | | CDR3 | 481 | CNMESLSYRHYW |
| | | FW4 | 567 | GQGTQVTVSS |
| | | VH AA | 653 | QVQLQESGGGLVQTGGSLRLSCTASGSIFDIARGNWYRQAPGKQRELVAIITSGGATNYADSVAGRFTISRGTAWKALYLQMNSLKPEDTAVYFCNMESLSYRHYWGQGTQVTVSS |
| SID1R2P5A5 | 1 | FW1 | 52 | QVQLQESGGGLVRTGGSLRLSCTASG |
| | | CDR1 | 138 | SIFDIARGN |
| | | FW2 | 224 | WYRQAPGKQRELV |
| | | CDR2 | 310 | AIITSGGATNYA |
| | | FW3 | 396 | DSVAGRFTISRDTAWKALYLQMNSLKPEDTAVYF |
| | | CDR3 | 482 | CNMESLSYRHYW |
| | | FW4 | 568 | GQGTQVTVSS |
| | | VH AA | 654 | QVQLQESGGGLVRTGGSLRLSCTASGSIFDIARGNWYRQAPGKQRELVAIITSGGATNYADSVAGRFTISRDTAWKALYLQMNSLKPEDTAVYFCNMESLSYRHYWGQGTQVTVSS |
| SID1R3aP4A5 | 1 | FW1 | 53 | QVQLQESGGGLVRPGGSLRLSCTASG |
| | | CDR1 | 139 | SIFDIARGN |
| | | FW2 | 225 | WYRQAPGKQRELV |
| | | CDR2 | 311 | AIITSGGATNYA |

TABLE 5-continued

Table of Exemplary Sequences

| TCR | Clono type | Component | SEQ ID NO: | Sequence |
|---|---|---|---|---|
| | | FW3 | 397 | DSVAGRFTISRDTAWKALYLQMNSL KPEDTAVYF |
| | | CDR3 | 483 | CNMESLSYRHYW |
| | | FW4 | 569 | GQGTQVTVSS |
| | | VH AA | 655 | QVQLQESGGGLVRPGGSLRLSCTAS GSIFDIARGNWYRQAPGKQRELVAI ITSGGATNYADSVAGRFTISRDTAW KALYLQMNSLKPEDTAVYFCNMESL SYRHYWGQGTQVTVSS |
| 3HCDS115 | 1 | FW1 | 54 | QVQLQESGGGLVQPGGSLRLSCTAS G |
| | | CDR1 | 140 | SIFDIARGN |
| | | FW2 | 226 | WYRQAPGKQRELV |
| | | CDR2 | 312 | AIVTSGGATNYA |
| | | FW3 | 398 | DSVAGRFTISRDTAWKALYLQMNSL KPEDTAVYF |
| | | CDR3 | 484 | CNMESLSYRHYW |
| | | FW4 | 570 | GQGTQVTVSS |
| | | VH AA | 656 | QVQLQESGGGLVQPGGSLRLSCTAS GSIFDIARGNWYRQAPGKQRELVAI VTSGGATNYADSVAGRFTISRDTAW KALYLQMNSLKPEDTAVYFCNMESL SYRHYWGQGTQVTVSS |
| SID1R3aP4F3 | 1 | FW1 | 55 | QVQLQESGGGLVQPGESLRLSCTAS G |
| | | CDR1 | 141 | SIFDIARGN |
| | | FW2 | 227 | WYRQAPGKQRELV |
| | | CDR2 | 313 | AIITSGGATNYA |
| | | FW3 | 399 | DSVAGRFTISRDTAWKALYLQMNSL KPEDTAVYF |
| | | CDR3 | 485 | CNMESLSYRHYW |
| | | FW4 | 571 | GQGTQVTVSS |
| | | VH AA | 657 | QVQLQESGGGLVQPGESLRLSCTAS GSIFDIARGNWYRQAPGKQRELVAI ITSGGATNYADSVAGRFTISRDTAW KALYLQMNSLKPEDTAVYFCNMESL SYRHYWGQGTQVTVSS |
| SID1R3aP7A2 | 1 | FW1 | 56 | QVQLQESGGGLVQPGGSLRLSCTAS G |
| | | CDR1 | 142 | SIFDIARGN |
| | | FW2 | 228 | WYRQAPGKQRELV |
| | | CDR2 | 314 | AIITSGGATNYA |
| | | FW3 | 400 | DSVAGRFTISRDTAWKALYLQMNSL KPEDTAVYF |
| | | CDR3 | 486 | CNMESLSYRHYW |
| | | FW4 | 572 | GKGTQVTVSS |

TABLE 5-continued

Table of Exemplary Sequences

| TCR | Clono type | Component | SEQ ID NO: | Sequence |
|---|---|---|---|---|
| | | VH AA | 658 | QVQLQESGGGLVQPGGSLRLSCTAS GSIFDIARGNWYRQAPGKQRELVAI ITSGGATNYADSVAGRFTISRDTAW KALYLQMNSLKPEDTAVYFCNMESL SYRHYWGKGTQVTVSS |
| SID1R3P6G10 | 1 | FW1 | 57 | QVQLQESGGGLVQPGGSLRLSCTAS G |
| | | CDR1 | 143 | SIFDIARGN |
| | | FW2 | 229 | WYRQAPGKQRELV |
| | | CDR2 | 315 | AIITSGGATNYA |
| | | FW3 | 401 | DSVAGRFTISRDTAWKALYLQMNSL KPEDTAVYF |
| | | CDR3 | 487 | CNMESLSYRHYW |
| | | FW4 | 573 | GQGTQVTVSS |
| | | VH AA | 659 | QVQLQESGGGLVQPGGSLRLSCTAS GSIFDIARGNWYRQAPGKQRELVAI ITSGGATNYADSVAGRFTISRDTAW KALYLQMNSLKPEDTAVYFCNMESL SYRHYWGQGTQVTVSS |
| SID1R2P1B10 | 1 | FW1 | 58 | QVQLQESGGGSVQPGGSLRLSCTAS G |
| | | CDR1 | 144 | SIFDIARGN |
| | | FW2 | 230 | WYRQAPGKQRELV |
| | | CDR2 | 316 | AIITSGGATNYA |
| | | FW3 | 402 | DSVAGRFTISRDTAWKALYLQMNSL KPEDTAVYF |
| | | CDR3 | 488 | CNMESLSYRHYW |
| | | FW4 | 574 | GQGTQVTVSS |
| | | VH AA | 660 | QVQLQESGGGSVQPGGSLRLSCTAS GSIFDIARGNWYRQAPGKQRELVAI ITSGGATNYADSVAGRFTISRDTAW KALYLQMNSLKPEDTAVYFCNMESL SYRHYWGQGTQVTVSS |
| SID1R3P4B1 | 1 | FW1 | 59 | QVQLQESGGGLVQAGGSLRLSCTAS G |
| | | CDR1 | 145 | SIFDIARGN |
| | | FW2 | 231 | WYRQAPGKQRELV |
| | | CDR2 | 317 | AIITSGGATNYA |
| | | FW3 | 403 | DSVAGRFTISRDTAWKALYLQMNSL KPEDTAVYF |
| | | CDR3 | 489 | CNMESLSYRHYW |
| | | FW4 | 575 | GQGTQVTVSS |
| | | VH AA | 661 | QVQLQESGGGLVQAGGSLRLSCTAS GSIFDIARGNWYRQAPGKQRELVAI ITSGGATNYADSVAGRFTISRDTAW KALYLQMNSLKPEDTAVYFCNMESL SYRHYWGQGTQVTVSS |
| 2HCDS45 | 1 | FW1 | 60 | QVQLQESGGGSVQAGGSLRLSCTAS G |

TABLE 5-continued

| Table of Exemplary Sequences | | | | |
|---|---|---|---|---|
| TCR | Clono type | Component | SEQ ID NO: | Sequence |
| | | CDR1 | 146 | SIFDIARGN |
| | | FW2 | 232 | WYRQAPGKQRELV |
| | | CDR2 | 318 | AIVTSGGATNYA |
| | | FW3 | 404 | DSVAGRFTISRDTAWKALYLQMNSL KPEDTAVYF |
| | | CDR3 | 490 | CNMESLSYRHYW |
| | | FW4 | 576 | GQGTQVTVSS |
| | | VH AA | 662 | QVQLQESGGGSVQAGGSLRLSCTAS GSIFDIARGNWYRQAPGKQRELVAI VTSGGATNYADSVAGRFTISRDTAW KALYLQMNSLKPEDTAVYFCNMESL SYRHYWGQGTQVTVSS |
| 3HCDS108 | 1 | FW1 | 61 | QVQLQESGGGSVQAGGSLRLSCTAS G |
| | | CDR1 | 147 | SIFDIARGN |
| | | FW2 | 233 | WYRQAPGKQRELV |
| | | CDR2 | 319 | AIITSGGATNYA |
| | | FW3 | 405 | DSVAGRFTISRDTAWKALYLQMNSL KPEDTAVYF |
| | | CDR3 | 491 | CNMESLSYRHYW |
| | | FW4 | 577 | GQGTQVTVSS |
| | | VH AA | 663 | QVQLQESGGGSVQAGGSLRLSCTAS GSIFDIARGNWYRQAPGKQRELVAI ITSGGATNYADSVAGRFTISRDTAW KALYLQMNSLKPEDTAVYFCNMESL SYRHYWGQGTQVTVSS |
| SID1R2P6E2 | 1 | FW1 | 62 | QVQLQESGGGSVQTGGSLRLSCTAS G |
| | | CDR1 | 148 | SIFDIARGN |
| | | FW2 | 234 | WYRQAPGKQRELV |
| | | CDR2 | 320 | AIITSGGATNYA |
| | | FW3 | 406 | DSVAGRFTISRDTAWKALYLQMNSL KPEDTAVYF |
| | | CDR3 | 492 | CNMESLSYRHYW |
| | | FW4 | 578 | GQGTQVTVSS |
| | | VH AA | 664 | QVQLQESGGGSVQTGGSLRLSCTAS GSIFDIARGNWYRQAPGKQRELVAI ITSGGATNYADSVAGRFTISRDTAW KALYLQMNSLKPEDTAVYFCNMESL SYRHYWGQGTQVTVSS |
| 2HCDS101 | 1 | FW1 | 63 | QVQLQESGGGLVHPGGSLRLSCTAS G |
| | | CDR1 | 149 | SIFDIVRGS |
| | | FW2 | 235 | WYRQAPGKQRELV |
| | | CDR2 | 321 | AUTSGGATNYA |
| | | FW3 | 407 | DSVAGRFTISRDSAWKALYLQMNSL KPEDTAVYL |

TABLE 5-continued

| Table of Exemplary Sequences | | | | |
|---|---|---|---|---|
| TCR | Clono type | Component | SEQ ID NO: | Sequence |
| | | CDR3 | 493 | CNMESLRYRNYW |
| | | FW4 | 579 | GQGTQVTVSS |
| | | VH AA | 665 | QVQLQESGGGLVHPGGSLRLSCTAS GSIFDIVRGSWYRQAPGKQRELVAI ITSGGATNYADSVAGRFTISRDSAW KALYLQMNSLKPEDTAVYLCNMESL RYRNYWGQGTQVTVSS |
| 3HCDS59 | 1 | FW1 | 64 | QVQLQESGGGLVQTGGSLRLSCTAS G |
| | | CDR1 | 150 | SIFDIVRGS |
| | | FW2 | 236 | WYRQAPGKQRELV |
| | | CDR2 | 322 | AIITSGGATNYA |
| | | FW3 | 408 | DSVAGRFTISRDSAWKALYLQMNSL KPEDTAVYL |
| | | CDR3 | 494 | CNMESLRYRNYW |
| | | FW4 | 580 | GQGTQVTVSS |
| | | VH AA | 666 | QVQLQESGGGLVQTGGSLRLSCTAS GSIFDIVRGSWYRQAPGKQRELVAI ITSGGATNYADSVAGRFTISRDSAW KALYLQMNSLKPEDTAVYLCNMESL RYRNYWGQGTQVTVSS |
| SID1R2P10E12 | 1 | FW1 | 65 | QVQLQESGGGLVRPGGSLRLSCTAS G |
| | | CDR1 | 151 | SIFDIVRGS |
| | | FW2 | 237 | WYRQAPGKQRELV |
| | | CDR2 | 323 | AIITSGGATNYA |
| | | FW3 | 409 | DSVAGRFTISRDSAWKALYLQMNSL KPEDTAVYF |
| | | CDR3 | 495 | CNMESLRYRHYW |
| | | FW4 | 581 | GQGTQVTVSS |
| | | VH AA | 667 | QVQLQESGGGLVRPGGSLRLSCTAS GSIFDIVRGSWYRQAPGKQRELVAI ITSGGATNYADSVAGRFTISRDSAW KALYLQMNSLKPEDTAVYFCNMESL RYRHYWGQGTQVTVSS |
| SID1R2P13A9 | 1 | FW1 | 66 | QVQLQESGGGLVQTGGPLRLSCTAS G |
| | | CDR1 | 152 | SIFDIVRGS |
| | | FW2 | 238 | WYRQAPGKQRELV |
| | | CDR2 | 324 | AIITSGGATNYA |
| | | FW3 | 410 | DSVAGRFTISRDSAWKALYLQMNSL KPEDTAVYF |
| | | CDR3 | 496 | CNMESLRYRHYW |
| | | FW4 | 582 | GQGTQVTVSS |
| | | VH AA | 668 | QVQLQESGGGLVQTGGPLRLSCTAS GSIFDIVRGSWYRQAPGKQRELVAI ITSGGATNYADSVAGRFTISRDSAW |

TABLE 5-continued

| Table of Exemplary Sequences | | | | |
|---|---|---|---|---|
| TCR | Clono type | Component | SEQ ID NO: | Sequence |
| | | | | KALYLQMNSLKPEDTAVYFCNMESL RYRHYWGQGTQVTVSS |
| SID1R2P17C8 | 1 | FW1 | 67 | QVQLQESGGGLVQTGGSLRLSCTAS G |
| | | CDR1 | 153 | SIFDIVRGS |
| | | FW2 | 239 | WYRQAPGKQRELV |
| | | CDR2 | 325 | AIITSGGATNYA |
| | | FW3 | 411 | DSVAGRFTISRDSAWKALYLQVNSL KPEDTAVYF |
| | | CDR3 | 497 | CNMESLRYRHYW |
| | | FW4 | 583 | GQGTQVTVSS |
| | | VH AA | 669 | QVQLQESGGGLVQTGGSLRLSCTAS GSIFDIVRGSWYRQAPGKQRELVAI ITSGGATNYADSVAGRFTISRDSAW KALYLQVNSLKPEDTAVYFCNMESL RYRHYWGQGTQVTVSS |
| 3HCDS171 | 1 | FW1 | 68 | QVQLQESGGGLVQTGGSLRLSCTAS G |
| | | CDR1 | 154 | SIFDIVRGS |
| | | FW2 | 240 | WYRQAPGKQRELV |
| | | CDR2 | 326 | AIITSGGATNYA |
| | | FW3 | 412 | DSVAGRFTISRDSAWKALYLQMDSL KPEDTAVYF |
| | | CDR3 | 498 | CNMESLRYRHYW |
| | | FW4 | 584 | GQGTQVTVSS |
| | | VH AA | 670 | QVQLQESGGGLVQTGGSLRLSCTAS GSIFDIVRGSWYRQAPGKQRELVAI ITSGGATNYADSVAGRFTISRDSAW KALYLQMDSLKPEDTAVYFCNMESL RYRHYWGQGTQVTVSS |
| 3HCDS173 | 1 | FW1 | 69 | QVQLQESGGGLVQPGGSLRLSCTAS G |
| | | CDR1 | 155 | SIFDIVRGS |
| | | FW2 | 241 | WYRQAPGKQRELV |
| | | CDR2 | 327 | AIITSGGATNYA |
| | | FW3 | 413 | DSVAGRFTISRDSAWKALYLQMNSL KPEDTAVYF |
| | | CDR3 | 499 | CNMESLRYRHYW |
| | | FW4 | 585 | GQGTQVTVSS |
| | | VH AA | 671 | QVQLQESGGGLVQPGGSLRLSCTAS GSIFDIVRGSWYRQAPGKQRELVAI ITSGGATNYADSVAGRFTISRDSAW KALYLQMNSLKPEDTAVYFCNMESL RYRHYWGQGTQVTVSS |
| SID1R3P15F9 | 1 | FW1 | 70 | QVQLQESGGGLVQTGGSLRLSCTAS G |
| | | CDR1 | 156 | SIFDIVRGS |
| | | FW2 | 242 | WYRQAPGKQRELV |

TABLE 5-continued

Table of Exemplary Sequences

| TCR | Clono type | Component | SEQ ID NO: | Sequence |
|---|---|---|---|---|
| | | CDR2 | 328 | AIITSGGATNYA |
| | | FW3 | 414 | DSVAGRFTISRDSAWKALYLQMNSL KPEDTAVYF |
| | | CDR3 | 500 | CNMESLRYRHYW |
| | | FW4 | 586 | GQGTQVTVSS |
| | | VH AA | 672 | QVQLQESGGGLVQTGGSLRLSCTAS GSIFDIVRGSWYRQAPGKQRELVAI ITSGGATNYADSVAGRFTISRDSAW KALYLQMNSLKPEDTAVYFCNMESL RYRHYWGQGTQVTVSS |
| 3HCDS176 | 2 | FW1 | 71 | QVQLQESGGGLVEPGESLTLSCVAS G |
| | | CDR1 | 157 | LSFDRYAIG |
| | | FW2 | 243 | WFRQAPGKEREGV |
| | | CDR2 | 329 | ACISSKGGLTKYA |
| | | FW3 | 415 | DSVKGRFTISRDNEKNTTYLQMNSL KPEDTAVYY |
| | | CDR3 | 501 | CAAAGPPDDCSVPGYYGLNYW |
| | | FW4 | 587 | GKGTQVTVSS |
| | | VH AA | 673 | QVQLQESGGGLVEPGESLTLSCVAS GLSFDRYAIGWFRQAPGKEREGVAC ISSKGGLTKYADSVKGRFTISRDNE KNTTYLQMNSLKPEDTAVYYCAAAG PPDDCSVPGYYGLNYWGKGTQVTVS S |
| 3HCDS165 | 2 | FW1 | 72 | QVQLQESGGGLVQPGGSLRLSCAAS G |
| | | CDR1 | 158 | FTLERYAVG |
| | | FW2 | 244 | WFRQAPGKEREGV |
| | | CDR2 | 330 | SCVSSSGDITKYA |
| | | FW3 | 416 | DSAKGRFTISRDNAKNMAYLQMNSL KPEDTAVYY |
| | | CDR3 | 502 | CAAAGPADDCSVHGYYGLNYW |
| | | FW4 | 588 | GKGTQVTVSS |
| | | VH AA | 674 | QVQLQESGGGLVQPGGSLRLSCAAS GFTLERYAVGWFRQAPGKEREGVSC VSSSGDITKYADSAKGRFTISRDNA KNMAYLQMNSLKPEDTAVYYCAAAG PADDCSVHGYYGLNYWGKGTQVTVS S |
| SID1R3P6F10 | 2 | FW1 | 73 | QVQLQESGGGLVQPGGSLRLSCAAS G |
| | | CDR1 | 159 | FTLEHYSIG |
| | | FW2 | 245 | WFRQAPGKDLEGV |
| | | CDR2 | 331 | SCITSSGGIPKYA |
| | | FW3 | 417 | DSVKGRFIISRDNAKKMGYLQMNSL KPEDTAVYY |

TABLE 5-continued

Table of Exemplary Sequences

| TCR | Clono type | Component | SEQ ID NO: | Sequence |
|---|---|---|---|---|
| | | CDR3 | 503 | CGAATPDDDCSVAGHYGLNYW |
| | | FW4 | 589 | GKGTQVTVSS |
| | | VH AA | 675 | QVQLQESGGGLVQPGGSLRLSCAAS GFTLEHYSIGWFRQAPGKDLEGVSC ITSSGGIPKYADSVKGRFIISRDNA KKMGYLQMNSLKPEDTAVYYCGAAT PDDDCSVAGHYGLNYWGKGTQVTVS S |
| SID1R2P20C4 | 2 | FW1 | 74 | QVQLQESGGGLVQPGGSLRLSCAAS G |
| | | CDR1 | 160 | FTLEHYSMG |
| | | FW2 | 246 | WFRQAPGKDLEGV |
| | | CDR2 | 332 | SCITSSGGIPKYA |
| | | FW3 | 418 | DSVKGRFIISRDNAKNTGYLQMNSL KPEDTAVYY |
| | | CDR3 | 504 | CGAATPDDDCSVPGHYGLNYW |
| | | FW4 | 590 | GKGTQVTVSS |
| | | VH AA | 676 | QVQLQESGGGLVQPGGSLRLSCAAS GFTLEHYSMGWFRQAPGKDLEGVSC ITSSGGIPKYADSVKGRFIISRDNA KNTGYLQMNSLKPEDTAVYYCGAAT PDDDCSVPGHYGLNYWGKGTQVTVS S |
| 3HCDS124 | 2 | FW1 | 75 | QVQLQESGGGFVQPGGSLQLSCAVS G |
| | | CDR1 | 161 | RSRDYYSIN |
| | | FW2 | 247 | WFRQAPGKEREGV |
| | | CDR2 | 333 | SCISSSGGITKYA |
| | | FW3 | 419 | DSVKGRFIIARDNTKNRAYLQMSSL KPEDTAVYY |
| | | CDR3 | 505 | CAAAGPPDDCSVPGYYGLNYW |
| | | FW4 | 591 | GKGTQVTVSS |
| | | VH AA | 677 | QVQLQESGGGFVQPGGSLQLSCAVS GRSRDYYSINWFRQAPGKEREGVSC ISSSGGITKYADSVKGRFIIARDNT KNRAYLQMSSLKPEDTAVYYCAAAG PPDDCSVPGYYGLNYWGKGTQVTVS S |
| 3HCDS137 | 2 | FW1 | 76 | QVQLQESGGGLVQPGGSLRLSCAVS G |
| | | CDR1 | 162 | FTLEHYTIG |
| | | FW2 | 248 | WFRQAPGKELEGV |
| | | CDR2 | 334 | SCITSSGGVVKYA |
| | | FW3 | 420 | DSVKGRFIISRDNTNNRAFLQMSSL KPEDTAVYY |
| | | CDR3 | 506 | CAAAGPPDDCSVPGYYGLNYW |
| | | FW4 | 592 | GKGTQVTVSS |

TABLE 5-continued

| Table of Exemplary Sequences | | | | |
|---|---|---|---|---|
| TCR | Clono type | Component | SEQ ID NO: | Sequence |
| | | VH AA | 678 | QVQLQESGGGLVQPGGSLRLSCAVS GFTLEHYTIGWFRQAPGKELEGVSC ITSSGGVVKYADSVKGRFIISRDNT NNRAFLQMSSLKPEDTAVYYCAAAG PPDDCSVPGYYGLNYWGKGTQVTVS S |
| SID1R2P17H11 | 2 | FW1 | 77 | QVQLQESGGGLVQPGGSLRLSCVAP G |
| | | CDR1 | 163 | FTLDKYAIG |
| | | FW2 | 249 | WFRQAPGKELEGV |
| | | CDR2 | 335 | SCITSSSGVVKYA |
| | | FW3 | 421 | DSVKGRFIISRDNTNNRAFLQMSSL KPEDTAVYY |
| | | CDR3 | 507 | CAAAGPPDDCSVPGYYGLNYW |
| | | FW4 | 593 | GQGTQVTVSS |
| | | VH AA | 679 | QVQLQESGGGLVQPGGSLRLSCVAP GFTLDKYAIGWFRQAPGKELEGVSC ITSSSGVVKYADSVKGRFIISRDNT NNRAFLQMSSLKPEDTAVYYCAAAG PPDDCSVPGYYGLNYWGQGTQVTVS S |
| SID1R2P21B5 | 2 | FW1 | 78 | QVQLQESGGGLVQPGGSLRLSCVAS G |
| | | CDR1 | 164 | FTLDKYAIG |
| | | FW2 | 250 | WFRQAPGKELEGV |
| | | CDR2 | 336 | SCITSSGGVVKYA |
| | | FW3 | 422 | DSVKGRFIISRDNTNNRAFLQMSSL KPEDTAVYY |
| | | CDR3 | 508 | CAAAGPPDDCSVPGYYGLNYW |
| | | FW4 | 594 | GKGTQVTVSS |
| | | VH AA | 680 | QVQLQESGGGLVQPGGSLRLSCVAS GFTLDKYAIGWFRQAPGKELEGVSC ITSSGGVVKYADSVKGRFIISRDNT NNRAFLQMSSLKPEDTAVYYCAAAG PPDDCSVPGYYGLNYWGKGTQVTVS S |
| 2HCDS18 | 2 | FW1 | 79 | QVQLQESGGGLVQPGGSLRLSCGAS D |
| | | CDR1 | 165 | FTLENYAIG |
| | | FW2 | 251 | WFRQAPGKEREGV |
| | | CDR2 | 337 | SCITSSGGITKYA |
| | | FW3 | 423 | DSVKGRFIISRDNTKNRAYLQMNSL KPEDTAVYY |
| | | CDR3 | 509 | CAAAGPPDDCSVPGYYGLNYW |
| | | FW4 | 595 | GKGTQVTVSS |
| | | VH AA | 681 | QVQLQESGGGLVQPGGSLRLSCGAS DFTLENYAIGWFRQAPGKEREGVSC ITSSGGITKYADSVKGRFIISRDNT KNRAYLQMNSLKPEDTAVYYCAAAG |

TABLE 5-continued

| Table of Exemplary Sequences | | | | |
|---|---|---|---|---|
| TCR | Clono type | Component | SEQ ID NO: | Sequence |
| | | | | PPDDCSVPGYYGLNYWGKGTQVTVSS |
| 3HCDS132 | 2 | FW1 | 80 | QVQLQESGGGLVQPGGSLRLSCTASD |
| | | CDR1 | 166 | FNLERYAIN |
| | | FW2 | 252 | WFRQAPGKEREGV |
| | | CDR2 | 338 | LCITSSGGITKYA |
| | | FW3 | 424 | NSVKGRFIISRDNTKNRAYLQMNSLKPEDTAVYY |
| | | CDR3 | 510 | CAAAGPPDDCSVPGYYGLNYW |
| | | FW4 | 596 | GKGTQVTVSS |
| | | VH AA | 682 | QVQLQESGGGLVQPGGSLRLSCTASDFNLERYAINWFRQAPGKEREGVLCITSSGGITKYANSVKGRFIISRDNTKNRAYLQMNSLKPEDTAVYYCAAAGPPDDCSVPGYYGLNYWGKGTQVTVSS |
| 3HCDS131 | 2 | FW1 | 81 | QVQLQESGGGLVQPGGSLRLSCVASG |
| | | CDR1 | 167 | FTLDYYAIN |
| | | FW2 | 253 | WFRQAPGKEREGV |
| | | CDR2 | 339 | LCITSNGGITKYA |
| | | FW3 | 425 | DSVKGRFIISRDNTKNRAYLQMNSLKPEDTAVYY |
| | | CDR3 | 511 | CAAAGPPDDCSVPGYYGLNYW |
| | | FW4 | 597 | GKGTQVTVSS |
| | | VH AA | 683 | QVQLQESGGGLVQPGGSLRLSCVASGFTLDYYAINWFRQAPGKEREGVLCITSNGGITKYADSVKGRFIISRDNTKNRAYLQMNSLKPEDTAVYYCAAAGPPDDCSVPGYYGLNYWGKGTQVTVSS |
| 2HCDS17 | 3 | FW1 | 82 | QVQLQESGGGLVQAGGSLRLSCAASG |
| | | CDR1 | 168 | FTFDAYAIG |
| | | FW2 | 254 | WFRQAPGKEREGV |
| | | CDR2 | 340 | ICLSPSDGSTYYA |
| | | FW3 | 426 | DSVKGRFTISSDNAKNTVYLQMNSLKPEDTAVYY |
| | | CDR3 | 512 | CAAPSWCSLKADFGSW |
| | | FW4 | 598 | GQGTQVTVSS |
| | | VH AA | 684 | QVQLQESGGGLVQAGGSLRLSCAASGFTFDAYAIGWFRQAPGKEREGVICLSPSDGSTYYADSVKGRFTISSDNAKNTVYLQMNSLKPEDTAVYYCAAPSWCSLKADFGSWGQGTQVTVSS |
| SID1R2P20C6 | 3 | FW1 | 83 | QVQLQESGGGLVQPGGSLRLSCAASG |

TABLE 5-continued

| Table of Exemplary Sequences | | | | |
|---|---|---|---|---|
| TCR | Clono type | Component | SEQ ID NO: | Sequence |
| | | CDR1 | 169 | FTFDAYAIG |
| | | FW2 | 255 | WFRQAPGKEREGV |
| | | CDR2 | 341 | ICLSPSDGSTYYA |
| | | FW3 | 427 | DSVKGRFTISSDNAKNTVYLQMNSL KPEDTAVYY |
| | | CDR3 | 513 | CAAPSWCSLKADFGSW |
| | | FW4 | 599 | GQGTQVTVSS |
| | | VH AA | 685 | QVQLQESGGGLVQPGGSLRLSCAAS GFTFDAYAIGWFRQAPGKEREGVIC LSPSDGSTYYADSVKGRFTISSDNA KNTVYLQMNSLKPEDTAVYYCAAPS WCSLKADFGSWGQGTQVTVSS |
| SID1R3P15G3 | 4 | FW1 | 84 | QVQLQESGGGLVQAGGSLRLSCAAS G |
| | | CDR1 | 170 | SIIRDNVMA |
| | | FW2 | 256 | WHRQAPGKQRELV |
| | | CDR2 | 342 | AIINIGGSGNVD |
| | | FW3 | 428 | DSVEGRFTISRDNAKNMVYLQMNSL KPEDTAVYY |
| | | CDR3 | 514 | CNVYYRDLW |
| | | FW4 | 600 | GQGTQVTVSS |
| | | VH AA | 686 | QVQLQESGGGLVQAGGSLRLSCAAS GSIIRDNVMAWHRQAPGKQRELVAI INIGGSGNVDDSVEGRFTISRDNAK NMVYLQMNSLKPEDTAVYYCNVYYR DLWGQGTQVTVSS |
| SID1R3P16C6 | 4 | FW1 | 85 | QVQLQESGGGLVQPGGSLRLSCTAS K |
| | | CDR1 | 171 | SIRDNVMA |
| | | FW2 | 257 | WHRQAPGKQRELV |
| | | CDR2 | 343 | AINTGGSANVD |
| | | FW3 | 429 | DSVKGRFTISRDNAKNMVYLQMNNL KPEDTAVYY |
| | | CDR3 | 515 | CNVYYRDLW |
| | | FW4 | 601 | GQGTQVTVSS |
| | | VH AA | 687 | QVQLQESGGGLVQPGGSLRLSCTAS KSIIRDNVMAWHRQAPGKQRELVAI INTGGSANVDDSVKGRFTISRDNAK NMVYLQMNNLKPEDTAVYYCNVYYR DLWGQGTQVTVSS |
| 3HCDS28 | 6 | FW1 | 86 | QVQLQESGGGLVQPGGSLRLSCTAS G |
| | | CDR1 | 172 | SIFSATRME |
| | | FW2 | 258 | WYRQAPGKQRELV |
| | | CDR2 | 344 | AIVTSGGRTNYA |
| | | FW3 | 430 | DSVNGRFTISRDNAKNTLYLQMNNL KPEDTAVYY |

TABLE 5-continued

| Table of Exemplary Sequences | | | | |
|---|---|---|---|---|
| TCR | Clono type | Component | SEQ ID NO: | Sequence |
| | | CDR3 | 516 | CKFERYDYVNYW |
| | | FW4 | 602 | GRGTQVTVSS |
| | | VH AA | 688 | QVQLQESGGGLVQPGGSLRLSCTASGSIFSATRMEWYRQAPGKQRELVAIVTSGGRTNYADSVNGRFTISRDNAKNTLYLQMNNLKPEDTAVYYCKFERYDYVNYWGRGTQVTVSS |

TABLE 6

| Table of Exemplary Sequences | |
|---|---|
| SEQ ID NO: | Sequence |
| 780 | MALPVTALLLPLALLLHAARPQVQLQESGGGLVQAGGSLRLSCTASGSIFSATRMEWYRQAPGKQRELVAIVTSGGRTNYADSVNGRFTISRDNAKNTLYLQMNNLKPEDTAVYYCKFERYDYVNYWGRGTQVTVSSGGGGSGGGGSGGGGSGGGGSAEKDEL |
| 781 | MALPVTALLLPLALLLHAARPQVQLQESGGGLVQAGGSLRLSCTASGSIFSATRMEWYRQAPGKQRELVAIVTSGGRTNYADSVNGRFTISRDNAKNTLYLQMNNLKPEDTAVYYCKFERYDYVNYWGRGTQVTVSSTTTPAPRPPTPAPTIASQPLSLRPEAC |

TABLE 6-continued

| Table of Exemplary Sequences | |
|---|---|
| SEQ ID NO: | Sequence |
| | RPAAGGAVHTRGLDFACDIYIWAPLAGTCGVLLLSLVITLYLYKYKSRRSFIDEKKMP |
| 1230 | HRDGIYMVHIQVTLAICSSTTAS |
| 1231 | ASRHHPTTLAVGICSPASRSISL |
| 1243 | SGGGSGGGGSGGGGSGGGGSGGGSLQ ($SG_3(SG_4)_3SG_3SLQ$ Linker) |

TABLE 7

| Table of Exemplary Anti-CD70 Binder Sequences | | | |
|---|---|---|---|
| Name | SEQ ID NO: | Component | Sequence |
| TC7-III-A11 | 783 | VH | QVQLVQSGAEVKRPGASVKVSCKASGYTFTSYYMHWVRQAPGQGLEWMGIINPSGGSTSYAQKFQGRVTMTRDTSTSTVYMELSSLRSEDTAVYYCAIEPGYCSGGSCYPDAFDIWGQGTTVTVSS |
| | 836 | CDRH1 | GYTFTSYYMH |
| | 889 | CDRH2 | GIINPSGGSTSYAQK |
| | 942 | CDRH3 | AIEPGYCSGGSCYPDAFDI |
| | 782 | Linker | GGSGGSGGSGGS |
| | 995 | VL | QSVLTQPPSASGTPGQRVTISCSGSSSNIGSDYVYWYQRVPGTAPKLLIYRDNQRPSGVPDRFSGSKSGTSASLAISGLRSDDEADYYCAAWDDSLSGWVFGGGTKVTVL |
| | 1048 | CDRL1 | SGSSSNIGSDYVY |
| | 1101 | CDRL2 | YRDNQRPS |
| | 1154 | CDRL3 | AAWDDSLSGWV |
| TC6-IV-B08 | 784 | VH | QVQLVESGGGVVQPGGSLRLSCAASGFTFSSYAMHWVRQAPGKGLEWVAVISYDGSNKYYADSVKGRFTISRDNSKNTLYLQMNSLRAEDTAVYYCARDGHPYYYGMDVWGQGTTVTVSS |
| | 837 | CDRH1 | GFTFSSYAMH |
| | 890 | CDRH2 | AVISYDGSNKYYADS |
| | 943 | CDRH3 | ARDGHPYYYGMDV |
| | 782 | Linker | GGSGGSGGSGGS |

TABLE 7-continued

Table of Exemplary Anti-CD70 Binder Sequences

| Name | SEQ ID NO: | Component | Sequence |
|---|---|---|---|
| | 996 | VL | QSALTQPASVSGSPGQSITISCTGTSSDVGDYNYVSWYQHHPGKAPKLMIYDVSNRPSGVSNRFSGSKSGNTASLTISGLQAEDEADYYCGSYTGSDTWVFGGGTKVTVL |
| | 1049 | CDRL1 | TGTSSDVGDYNYVS |
| | 1102 | CDRL2 | YDVSNRPS |
| | 1155 | CDRL3 | GSYTGSDTWV |
| TC4-I-C11 | 785 | VH | QVQLVQSGAEVKKPGSSVKVSCKASGGTFSSYAISWVRQAPGQGLEWMGWISAYNGNTNYAQKLQGRVTMTTDTSTSTAYMELRSLRSDDTAVYYCARVTPPGWLGNMDVWGKGTTVTVSS |
| | 838 | CDRH1 | GGTFSSYAIS |
| | 891 | CDRH2 | GWISAYNGNTNYAQK |
| | 944 | CDRH3 | ARVTPPGWLGNMDV |
| | 782 | Linker | GGSGGSGGSGGS |
| | 997 | VL | SYELMQSPSVSVAPGQTARITCGGRDIGSKSVHWYQQKPGQAPVLVVYDDSDRPSGIPERLSGSNFGNEATLTISRVEAGDEGDYFCQVWDSSTDVVFGGGTKVTVL |
| | 1050 | CDRL1 | GGRDIGSKSVH |
| | 1103 | CDRL2 | YDDSDRPS |
| | 1156 | CDRL3 | QVWDSSTDVV |
| TC4-XIII-A01 | 786 | VH | QVQLVQSGAEVKKPGASVKVSCKASGYTFTGYYMNWVRQAPGQGLEWMAWINPNTGDTNYAQKFQGRVTMTRDTSINTAYIELSRLTSDDTAVYYCARVGDYYDRSGYYRHDAFDIWGQGTMVTVSS |
| | 839 | CDRH1 | GYTFTGYYMN |
| | 892 | CDRH2 | AWINPNTGDTNYAQK |
| | 945 | CDRH3 | ARVGDYYDRSGYYRHDAFDI |
| | 782 | Linker | GGSGGSGGSGGS |
| | 998 | VL | SSELTQDPAVSVALGQTVRITCQGDSLRSYYASWYQQKPGQAPVLVIYGKNNRPSGIPDRFSGSSSGNTASLTITGAQAMDEADYYCQAWDSSTGVVFGGGTKVTVL |
| | 1051 | CDRL1 | QGDSLRSYYAS |
| | 1104 | CDRL2 | YGKNNRPS |
| | 1157 | CDRL3 | QAWDSSTGVV |
| TC7-V-G06 | 787 | VH | QMQLVQSGAEVKKPGSSVKVSCKASGGTFSSYAISWVRQAPGQGLEWMGWISAYNGNTNYAQKLQGRVTMTTDTSTSTAYMELRSLRSDDTAVYYCARDDYWGQGTLVTVSS |
| | 840 | CDRH1 | GGTFSSYAIS |
| | 893 | CDRH2 | GWISAYNGNTNYAQK |
| | 946 | CDRH3 | ARDDY |
| | 782 | Linker | GGSGGSGGSGGS |
| | 999 | VL | SYELTQPPSVSVAPGKTARITCSGDVLGENYADWYQQKPGQAPELVIYEDSERYPGIPERFSGSTSGNTTTLTISRVLTEDEADYYCLSGDEDNRVFGGGTKLTVL |
| | 1052 | CDRL1 | SGDVLGENYAD |
| | 1105 | CDRL2 | YEDSERYP |

TABLE 7-continued

Table of Exemplary Anti-CD70 Binder Sequences

| Name | SEQ ID NO: | Component | Sequence |
|---|---|---|---|
| | 1158 | CDRL3 | LSGDEDNRV |
| TC7-IV-E09 | 788 | VH | QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARSRRPYWYFDLWGRGTLVTVSS |
| | 841 | CDRH1 | GGSFSGYYWS |
| | 894 | CDRH2 | GEINHSGSTNYNPS |
| | 947 | CDRH3 | ARSRRPYWYFDL |
| | 782 | Linker | GGSGGSGGSGGS |
| | 1000 | VL | QSALTQPASVSGSPGQSITISCTGTSSDVGGYNSVSWYRQHPGKAPKLMIYDVTNRPSGVSNRFSGSKSGNTASLTISGLQAEDEADYYCSSSSISATWVFGGGTKVTVL |
| | 1053 | CDRL1 | TGTSSDVGGYNSVS |
| | 1106 | CDRL2 | YDVTNRPS |
| | 1159 | CDRL3 | SSSSISATWV |
| TC7-III-G11 | 789 | VH | EVQLVQSGGGVVQPGRSLRLSCAASGFTFSSYAMHWVRQAPGKGLEWVAVISYDGSNKYYADSVKGRFTISRDNSKNTLYLQMNSLRAEDTAVYYCATNSGYDSDYYYGMDVWGQGTTVTVSS |
| | 842 | CDRH1 | GFTFSSYAMH |
| | 895 | CDRH2 | AVISYDGSNKYYADS |
| | 948 | CDRH3 | ATNSGYDSDYYYGMDV |
| | 782 | Linker | GGSGGSGGSGGS |
| | 1001 | VL | QSVLTQPPSMSGAPGQRVTISCTGSSSNIGAGYDVHWYQHLPGTGPKLLIHGNTNRPSGVPDRFSGSKSGTSASLAITGLQAEDEADYYCQSYDNSLGGYVVFGGGTKVTVL |
| | 1054 | CDRL1 | TGSSSNIGAGYDVH |
| | 1107 | CDRL2 | HGNTNRPS |
| | 1160 | CDRL3 | QSYDNSLGGYVV |
| TC7-V-H10 | 790 | VH | QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARSRRPYWYFDLWGRGTLVTVSS |
| | 843 | CDRH1 | GGSFSGYYWS |
| | 896 | CDRH2 | GEINHSGSTNYNPS |
| | 949 | CDRH3 | ARSRRPYWYFDL |
| | 782 | Linker | GGSGGSGGSGGS |
| | 1002 | VL | QSALTQPASVSGSPGQSITISCTGTSSDVGGYNSVSWYRQHPGKAPKLMIYDVTNRPSGVSNRFSGSKSGNTASLTISGLQAEDEADYYCSSSSISATWVFGGGTKLTVL |
| | 1055 | CDRL1 | TGTSSDVGGYNSVS |
| | 1108 | CDRL2 | YDVTNRPS |
| | 1161 | CDRL3 | SSSSISATWV |
| TC7-VIII-E07 | 791 | VH | QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARSRRPYWYFDLWGRGTLVTVSS |
| | 844 | CDRH1 | GGSFSGYYWS |
| | 897 | CDRH2 | GEINHSGSTNYNPS |

TABLE 7-continued

Table of Exemplary Anti-CD70 Binder Sequences

| Name | SEQ ID NO: | Component | Sequence |
|---|---|---|---|
| | 950 | CDRH3 | ARSRRPYWYFDL |
| | 782 | Linker | GGSGGSGGSGGS |
| | 1003 | VL | QSALTQPPSASGSPGQSVTISCTGTSSDVGGYDSVSWYQQHP GKAPKLMIYDVSNRPSGVSNRFSGSKSGNTASLTISGLQAED EADYYCSSYTSSTTLGWIFGGGTKLTVL |
| | 1056 | CDRL1 | TGTSSDVGGYDSVS |
| | 1109 | CDRL2 | YDVSNRPS |
| | 1162 | CDRL3 | SSYTSSTTLGWI |
| TC6-VII-A09 | 792 | VH | EVQLVQSGGGVVQPGRSLRLSCAASGFTFSSYGMHWVRQAPG KGLEWVAVISYDGSNKYYADSVKGRFTISRDNSKNTLYLQMN SLRAEDTAVYYCAKAGAPPHYYYGMDVWGQGTTVTVSS |
| | 845 | CDRH1 | GFTFSSYGMH |
| | 898 | CDRH2 | AVISYDGSNKYYADS |
| | 951 | CDRH3 | AKAGAPPHYYYGMDV |
| | 782 | Linker | GGSGGSGGSGGS |
| | 1004 | VL | QSALTQPASVSGSPGQSITISCTGTSSDVGGYDYVSWYQQHP GKAPKLMIYEVTDRPSGIPNRFSGSKSGNTASLTISGLQAED EADYYCSSYTYTSTLEVFGGGTKVTVL |
| | 1057 | CDRL1 | TGTSSDVGGYDYVS |
| | 1110 | CDRL2 | YEVTDRPS |
| | 1163 | CDRL3 | SSYTYTSTLEV |
| TC4-VII-F02 | 793 | VH | QLQLQESGPGLVKPSGTLSLTCAVSGGSISSSNWWSWVRQPP GKGLEWIGEIYHSGSTNYNPSLKSRVTISVDKSKNQFSLKLS SVTAADTAVYYCAGPGPDPNDAFDIWGQGTMVTVSS |
| | 846 | CDRH1 | GGSISSSNWWS |
| | 899 | CDRH2 | GEIYHSGSTNYNPS |
| | 952 | CDRH3 | AGPGPDPNDAFDI |
| | 782 | Linker | GGSGGSGGSGGS |
| | 1005 | VL | SSELTQDPAVSVALGQTVRITCQGDSLRSYYASWYQQLPGTA PKLLIYQDSKRPSGIPERFSGSNSGNTATLTISGTQAMDEAD YYCQAWDSSTAVFGGGTKLTVL |
| | 1058 | CDRL1 | QGDSLRSYYAS |
| | 1111 | CDRL2 | YQDSKRPS |
| | 1164 | CDRL3 | QAWDSSTAV |
| TC4-VII-C04 | 794 | VH | QVQLLESGGGLVQPGRSLRLSCAASGFTFDDYAMHWVRQAPG KGLEWVSGISWNSGSIGYADSVKGRFTISRDNAKNSLYLQMN SLRAEDTAVYYCARDLVYYYGMDVWGQGTTVTVSS |
| | 847 | CDRH1 | GFTFDDYAMH |
| | 900 | CDRH2 | SGISWNSGSIGYADS |
| | 953 | CDRH3 | ARDLVYYYGMDV |
| | 782 | Linker | GGSGGSGGSGGS |
| | 1006 | VL | QSVLTQPPSVSGTPGQGVSISCSGSSSNIGWKTVNWYQQVPG MAPKLLIYSDNQRPSGVPDRFSGSKSATSASLAISGLQSEDE ADYYCASWDASVNAPVFGGGTKLTVL |

TABLE 7-continued

| Table of Exemplary Anti-CD70 Binder Sequences | | | |
|---|---|---|---|
| Name | SEQ ID NO: | Component | Sequence |
| | 1059 | CDRL1 | SGSSSNIGWKTVN |
| | 1112 | CDRL2 | YSDNQRPS |
| | 1165 | CDRL3 | ASWDASVNAPV |
| TC7-VII-H02 | 795 | VH | QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARSRRPYWYFDLWGQGTLVTVSS |
| | 848 | CDRH1 | GGSFSGYYWS |
| | 901 | CDRH2 | GEINHSGSTNYNPS |
| | 954 | CDRH3 | ARSRRPYWYFDL |
| | 782 | Linker | GGSGGSGGSGGS |
| | 1007 | VL | QSALTQPASVSGSPGQSITISCTGTSSDVGAYDSVSWYLQYPGKAPKLMIYDVTNRPSGVSNRFSGSKSGNTASLTISGLQAEDEAHYYCISYTASSTYVVFGGGTKLTVL |
| | 1060 | CDRL1 | TGTSSDVGAYDSVS |
| | 1113 | CDRL2 | YDVTNRPS |
| | 1166 | CDRL3 | ISYTASSTYVV |
| TC7-VII-D05 | 796 | VH | QMQLVQSGGGVVQPGRSLRLSCAASGFTFSSYAMHWVRQAPGKGLEWVAVISYDGSNKYYADSVKGRFTISRDNSKNTLYLQMNSLRAEDTAVYYCARDALWDTATFDYWGQGTLVTVSS |
| | 849 | CDRH1 | GFTFSSYAMH |
| | 902 | CDRH2 | AVISYDGSNKYYADS |
| | 955 | CDRH3 | ARDALWDTATFDY |
| | 782 | Linker | GGSGGSGGSGGS |
| | 1008 | VL | SSELTQDPAVSVALGQTVRITCQGDSLRSYYASWYQQKPGQAPVLVIYGKNNRPSGIPDRFSGSSSGNTASLTITGAQAEDEADYYCNSRDSSGNPWVFGGGTKLTVL |
| | 1061 | CDRL1 | QGDSLRSYYAS |
| | 1114 | CDRL2 | YGKNNRPS |
| | 1167 | CDRL3 | NSRDSSGNPWV |
| TC7-VII-C02 | 797 | VH | QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARSPLWFGPPDAFDIWGQGTMVTVSS |
| | 850 | CDRH1 | GGSFSGYYWS |
| | 903 | CDRH2 | GEINHSGSTNYNPS |
| | 956 | CDRH3 | ARSPLWFGPPDAFDI |
| | 782 | Linker | GGSGGSGGSGGS |
| | 1009 | VL | QSALTQPPSASGSPGQSVSISCTGTSSDVGGYNYVSWYQQHPGKAPKLIIYDVDKRPSGIPERFSGSNSGNTATLTISGTQAMDEADYYCQAWDSSTEVVFGGGTKVTVL |
| | 1062 | CDRL1 | TGTSSDVGGYNYVS |
| | 1115 | CDRL2 | YDVDKRPS |
| | 1168 | CDRL3 | QAWDSSTEVV |
| TC7-III-D10 | 798 | VH | QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARDSSSWYYYYGMDVWGQGTTVTVSS |

TABLE 7-continued

| Table of Exemplary Anti-CD70 Binder Sequences | | | |
|---|---|---|---|
| Name | SEQ ID NO: | Component | Sequence |
| | 851 | CDRH1 | GYTFTSYGIS |
| | 904 | CDRH2 | GWISAYNGNTNYAQK |
| | 957 | CDRH3 | ARDSSSWYYYYGMDV |
| | 782 | Linker | GGSGGSGGSGGS |
| | 1010 | VL | SYELTQPPSVSVSPGQTARISCSGDALPNQYAYWYQQKPGQAPVLVIYQDSERPSGIPERFSGSSSGTTVTLTISGVQAEDEADYYCQSADTYGTSWVFGGGTKLTVL |
| | 1063 | CDRL1 | SGDALPNQYAY |
| | 1116 | CDRL2 | YQDSERPS |
| | 1169 | CDRL3 | QSADTYGTSWV |
| TC4-VII-G08 | 799 | VH | QVQLVQSGGGVVQPGRSLRLSCAASGFTFSSYAMHWVRQAPGKGLEWVAVISYDGSNKYYADSVKGRFTISRDNSKNTLYLQMNSLRAEDTAVYYCARDLSYDYGFDYWGQGTLVTVSS |
| | 852 | CDRH1 | GFTFSSYAMH |
| | 905 | CDRH2 | AVISYDGSNKYYADS |
| | 958 | CDRH3 | ARDLSYDYGFDY |
| | 782 | Linker | GGSGGSGGSGGS |
| | 1011 | VL | SSELTQDPAVSVALGQTVRITCQGDSLRSYYASWYQQKPGQAPVLVIYGKNNRPSGIPDRFSGSSSGNTASLTITGAQAEDEADYYCNSRDSSGNHLVVFGGGTKVTVL |
| | 1064 | CDRL1 | QGDSLRSYYAS |
| | 1117 | CDRL2 | YGKNNRPS |
| | 1170 | CDRL3 | NSRDSSGNHLVV |
| TC4-I-C10 | 800 | VH | EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCAISRTESYVMDVWGQGTTVTVSS |
| | 853 | CDRH1 | GYSFTSYWIG |
| | 906 | CDRH2 | GIIYPGDSDTRYSPS |
| | 959 | CDRH3 | AISRTESYVMDV |
| | 782 | Linker | GGSGGSGGSGGS |
| | 1012 | VL | QSALTQPRSVSGSPGQSVTISCTGTSSDVGGYNYVSWYQQHPGKAPKLMIYDVTNRPSGVPDRFSASKSDNTATLTVSGVQAEDEADYYCSSYAGSHELFGGGTKLTVL |
| | 1065 | CDRL1 | TGTSSDVGGYNYVS |
| | 1118 | CDRL2 | YDVTNRPS |
| | 1171 | CDRL3 | SSYAGSHEL |
| TC7-VIII-C02 | 801 | VH | QVQLLESGGGVVQPGRSLRLSCAASGFTFSSYGMHWVRQAPGKGLEWVAVISYDGSNKYYADSVKGRFTISRDNSKNTLYLQMNSLRAEDTAVYYCAKGAYYYGSVSGMDVWGQGTTVTVSS |
| | 854 | CDRH1 | GFTFSSYGMH |
| | 907 | CDRH2 | AVISYDGSNKYYADS |
| | 960 | CDRH3 | AKGAYYYGSVSGMDV |
| | 782 | Linker | GGSGGSGGSGGS |

TABLE 7-continued

| Table of Exemplary Anti-CD70 Binder Sequences | | | |
|---|---|---|---|
| Name | SEQ ID NO: | Component | Sequence |
| | 1013 | VL | SYELTQPVSVSVALGQTARLTCAGNNIGSKNVHWYQQKPSQAPVLVIYNDNIRPNFGIPERFSGSNSGNTATLTISSAQAGDEADYYCQVWDSSTAEVFGGGTKLTVL |
| | 1066 | CDRL1 | AGNNIGSKNVH |
| | 1119 | CDRL2 | YNDNIRPNF |
| | 1172 | CDRL3 | QVWDSSTAEV |
| TC7-V-G04 | 802 | VH | EVQLVQSGAEVKKPGASVKVSCKASGYTFTGYYMHWVRQAPGQGLEWMGWINPNSGGTNYAQKFQGWVTMTRDTSISTAYMELSRLRSDDTAVYYCARDPGWSYYYGMDVWGQGTTVTVSS |
| | 855 | CDRH1 | GYTFTGYYMH |
| | 908 | CDRH2 | GWINPNSGGTNYAQK |
| | 961 | CDRH3 | ARDPGWSYYYGMDV |
| | 782 | Linker | GGSGGSGGSGGS |
| | 1014 | VL | QSALTQPRSVSGSPGQSVTISCTGTSSDVGGYNYVSWYQQHPGKAPQLMIFEVSYRPSGVPDRFSGSKSGTSASLAISGLQSEDEADYYCAAWDDSLKGYVFGTGTKLTVL |
| | 1067 | CDRL1 | TGTSSDVGGYNYVS |
| | 1120 | CDRL2 | FEVSYRPS |
| | 1173 | CDRL3 | AAWDDSLKGYV |
| TC7-VI-F11 | 803 | VH | EVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDGYGFDYWGQGTLVTVSS |
| | 856 | CDRH1 | GFTFSSYAMH |
| | 909 | CDRH2 | AVISYDGSNKYYADS |
| | 962 | CDRH3 | ARDGYGFDY |
| | 782 | Linker | GGSGGSGGSGGS |
| | 1015 | VL | SYELTQSPSVSVAPGQTARITCGGNNIGSKSVHWYQQKPGQAPVLVVYDDSDRPSGIPERFSGSNSGNTATLTISRVEAGDEADYYCQVWDSSTPYVFGTGTKLTVL |
| | 1068 | CDRL1 | GGNNIGSKSVH |
| | 1121 | CDRL2 | YDDSDRPS |
| | 1174 | CDRL3 | QVWDSSTPYV |
| TC1.2-I-F07-6 | 804 | VH | QVQLVQSGAEVKKPGESLKISCKGSGYSFTSYWIGWVRQMPGKGLEWMGIIYPGESDTRYSPSFQGQVTISADKSISTAYLQWSSLKASDTAMYYCARRNYYDRSGYVDAFDIWGQGTMVTVSS |
| | 857 | CDRH1 | GYSFTSYWIG |
| | 910 | CDRH2 | GIIYPGESDTRYSPS |
| | 963 | CDRH3 | ARRNYYDRSGYVDAFDI |
| | 782 | Linker | GGSGGSGGSGGS |
| | 1016 | VL | SSELTQDPAVSVALGQTVRITCQGDSLRRFYASWHQQKPGQAPIVVMYAENNRPSGIPDRFSGSSSGNTASLTITGAQAEDEATYYCNSRDSSGNRHVFGTGTKLTVL |
| | 1069 | CDRL1 | QGDSLRRFYAS |
| | 1122 | CDRL2 | YAENNRPS |
| | 1175 | CDRL3 | NSRDSSGNRHV |

TABLE 7-continued

Table of Exemplary Anti-CD70 Binder Sequences

| Name | SEQ ID NO: | Component | Sequence |
|---|---|---|---|
| TC7-VII-E06 | 805 | VH | QVQLQQWGAGLLKPSETLSLTCAVYGGSFSGYYWSWIRQPPG KGLEWIGEINHSGSTNYNPSLKSRVTISVDTSKNQFSLKLSS VTAADTAVYYCARVARGKGAFDIWGQGTMVTVSS |
| | 858 | CDRH1 | GGSFSGYYWS |
| | 911 | CDRH2 | GEINHSGSTNYNPS |
| | 964 | CDRH3 | ARVARGKGAFDI |
| | 782 | Linker | GGSGGSGGSGGS |
| | 1017 | VL | QSALTQPASVSGSPGQSITISCTGTSSDIGGYNFVSWYQQHP GKAPKLMIYEVSNRPSGVSNRFSGSKSGNTASLTISGLQAED EADYYCSSYTSSSAWVFGGGTKLTVL |
| | 1070 | CDRL1 | TGTSSDIGGYNFVS |
| | 1123 | CDRL2 | YEVSNRPS |
| | 1176 | CDRL3 | SSYTSSSAWV |
| TC1.2-I-C08-1 | 806 | VH | QMQLVQSGAEVKKPGASVKVSCKASGYTFTSYGISWVRQAPG QGLEWMGWINPNTGGTDYAQKFQGRVTITRDTSITTGYMELS RLRSDDTAVYYCARHYYYGMDVWGQGTTVTVSS |
| | 859 | CDRH1 | GYTFTSYGIS |
| | 912 | CDRH2 | GWINPNTGGTDYAQK |
| | 965 | CDRH3 | ARHYYYGMDV |
| | 782 | Linker | GGSGGSGGSGGS |
| | 1018 | VL | DIQLTQSPSSLSASVGDRVTITCQASQDISNYLNWYQQKPGK APKLLIYDASNLETGVPSRFSGSGSGTDFTFTISSLQPEDIA TYYCQQYDNLPLTFGGGTKVEIK |
| | 1071 | CDRL1 | QASQDISNYLN |
| | 1124 | CDRL2 | YDASNLET |
| | 1177 | CDRL3 | QQYDNLPLT |
| TC4-V-E07 | 807 | VH | QVQLVQSGGGVVQPGRSLRLSCAASGFTFSSYAMHWVRQAPG KGLEWVAVISYDGSNKYYADSVKGRFTISRDNAKNSLYLQMN SLRDEDTAVYYCARDESFDYGVDVWGKGTTVTVSS |
| | 860 | CDRH1 | GFTFSSYAMH |
| | 913 | CDRH2 | AVISYDGSNKYYADS |
| | 966 | CDRH3 | ARDESFDYGVDV |
| | 782 | Linker | GGSGGSGGSGGS |
| | 1019 | VL | SSELTQDPAVSVALGQTVRITCQGDSLGRFYASWYQQKPGQA PVLVIYGKNNRPSGIPDRFSGSSSGNTASLTITGAQAEDEAD YYCNSRDSSGNHLVVFGGGTKLTVL |
| | 1072 | CDRL1 | QGDSLGRFYAS |
| | 1125 | CDRL2 | YGKNNRPS |
| | 1178 | CDRL3 | NSRDSSGNHLVV |
| TC4-I-G08 | 808 | VH | QVQLVQSGGGVVQPGRSLRLSCAASGFTFSSYAMHWVRQAPG KGLEWVAVISYDGSNKYYADSVKGRFTISRDNAKNSLYLQMN SLRDEDTAVYYCARDESFDYGVDVWGKGTTVTVSS |
| | 861 | CDRH1 | GFTFSSYAMH |
| | 914 | CDRH2 | AVISYDGSNKYYADS |

TABLE 7-continued

Table of Exemplary Anti-CD70 Binder Sequences

| Name | SEQ ID NO: | Component | Sequence |
|---|---|---|---|
| | 967 | CDRH3 | ARDESFDYGVDV |
| | 782 | Linker | GGSGGSGGSGGS |
| | 1020 | VL | SSELTQDPAVSVALGQTVRITCQGDSLRSYYASWYQQKPGQA PVLVIYGKNNRPSGIPDRFSGSSSGNTASLTITGAQAEDEAD YYCNSRDSSGNHLVVFGGGTKLTVL |
| | 1073 | CDRL1 | QGDSLRSYYAS |
| | 1126 | CDRL2 | YGKNNRPS |
| | 1179 | CDRL3 | NSRDSSGNHLVV |
| TC6-VI-D04 | 809 | VH | EVQLVQSGAEVKKPGASVKVSCKASGYTFTGYYMHWVRQAPG QGLEWMGWINPNSGGTNYAQKFQGWVTMTRDTSISTAYMELS RLRSDDTAVYYCARAGGWYRESSDAFDIWGQGTMVTVSS |
| | 862 | CDRH1 | GYTFTGYYMH |
| | 915 | CDRH2 | GWINPNSGGTNYAQK |
| | 968 | CDRH3 | ARAGGWYRESSDAFDI |
| | 782 | Linker | GGSGGSGGSGGS |
| | 1021 | VL | SYELTQPPSASGTPGQRVTISCSGSSSNIGSNYVYWYQQLPG TAPKLLIYRNNQRPSGVPDRFSGSKSGTSASLAISGLRSEDE ADYYCAAWDDSLSGYVFGTGIKVTVL |
| | 1074 | CDRL1 | SGSSSNIGSNYVY |
| | 1127 | CDRL2 | YRNNQRPS |
| | 1180 | CDRL3 | AAWDDSLSGYV |
| TC7-V-D10 | 810 | VH | QVQLQQWGAGLLKPSETLSLTCAVYGGSFSGYYWSWIRQPPG KGLEWIGEINHSGSTNYNPSLKSRVTISVDTSKNQFSLKLSS VTAADTAVYYCARGGYRSYWYFDLWGRGTLVTVSS |
| | 863 | CDRH1 | GGSFSGYYWS |
| | 916 | CDRH2 | GEINHSGSTNYNPS |
| | 969 | CDRH3 | ARGGYRSYWYFDL |
| | 782 | Linker | GGSGGSGGSGGS |
| | 1022 | VL | QSALTQPASVSGSPGQSITISCTGTSSDVGGYNSVSWYQHHP GKAPKLMIYDVSDRPSGVSDRFSGSKSGNTASLTISGLQAED EADYYCSSYAGSNNVVFGGGTKVTVL |
| | 1075 | CDRL1 | TGTSSDVGGYNSVS |
| | 1128 | CDRL2 | YDVSDRPS |
| | 1181 | CDRL3 | SSYAGSNNVV |
| TC7-VI-D10 | 811 | VH | QVQLQQWGAGLLKPSETLSLTCAVYGGSFSGYYWSWIRQPPG KGLEWIGEINHSGSTNYNPSLKSRVTISVDTSKNQFSLKLSS VTAADTAVYYCARVSRSRGAFDIWGQGTMVTVSS |
| | 864 | CDRH1 | GGSFSGYYWS |
| | 917 | CDRH2 | GEINHSGSTNYNPS |
| | 970 | CDRH3 | ARVSRSRGAFDI |
| | 782 | Linker | GGSGGSGGSGGS |
| | 1023 | VL | QSALTQPASVSGSPGQSLTISCTGTSSDVGVYNYVSWYQQHP GKAPKLMIYDVGIRPSGVSNRFSGSKSGNTASLTISGLQAAD EADYYCNSYTRSGTWVFGGGTKVTVL |
| | 1076 | CDRL1 | TGTSSDVGVYNYVS |

TABLE 7-continued

| Table of Exemplary Anti-CD70 Binder Sequences | | | |
|---|---|---|---|
| Name | SEQ ID NO: | Component | Sequence |
| | 1129 | CDRL2 | YDVGIRPS |
| | 1182 | CDRL3 | NSYTRSGTWV |
| TC7-VII-G05 | 812 | VH | QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARVSRSRGAFDIWGQGTMVTVSS |
| | 865 | CDRH1 | GGSFSGYYWS |
| | 918 | CDRH2 | GEINHSGSTNYNPS |
| | 971 | CDRH3 | ARVSRSRGAFDI |
| | 782 | Linker | GGSGGSGGSGGS |
| | 1024 | VL | QSALTQPASVSGSPGQSITISCTGTSSDIGGYDFVSWYQQPPGKAPKLVIYEVNRRPSGLSNRFSGSRSGNTASLTVSGLQTEDEADYYCSSYAGSNNWVFGGGTKLTVL |
| | 1077 | CDRL1 | TGTSSDIGGYDFVS |
| | 1130 | CDRL2 | YEVNRRPS |
| | 1183 | CDRL3 | SSYAGSNNWV |
| TC6-VI-F05 | 813 | VH | QVQLVQSGAEVKKPGASVKVSCKASGYTFTGYYMNWVRQAPGQGLEWMAWINPNTGDTNYAQKFQGRVTMTRDTSINTAYIELSRLTSDDTAVYYCARVGDYYDRSGYYRHDAFDIWGQGTMVTVSS |
| | 866 | CDRH1 | GYTFTGYYMN |
| | 919 | CDRH2 | AWINPNTGDTNYAQK |
| | 972 | CDRH3 | ARVGDYYDRSGYYRHDAFDI |
| | 782 | Linker | GGSGGSGGSGGS |
| | 1025 | VL | SSELTQDPAVSVALGQTVRITCQGDSLRSYYASWYQQKPGQAPVLVIYGKNNRPSGIPDRFSGSSSGNTASLTITGAQAMDEADYYCQAWDSSTVVVFGGGTKVTVL |
| | 1078 | CDRL1 | QGDSLRSYYAS |
| | 1131 | CDRL2 | YGKNNRPS |
| | 1184 | CDRL3 | QAWDSSTVVV |
| TC4-VIII-H08 | 814 | VH | EVQLVQSGGALVEPGGSLRLSCAASGFTFSSYAMHWVRQAPGKGLEWVAVISYDGSNKYYADSVKGRFTISRDNSKNTLYLQMNSLRAEDTAVYYCARDSTQDYGMDVWGQGTTVTVSS |
| | 867 | CDRH1 | GFTFSSYAMH |
| | 920 | CDRH2 | AVISYDGSNKYYADS |
| | 973 | CDRH3 | ARDSTQDYGMDV |
| | 782 | Linker | GGSGGSGGSGGS |
| | 1026 | VL | SSELTQDPAVSVALGQTVRITCQGDSLRNYYASWYQQKPGQAPVLVIYGKNNRPSGIPDRFSGSSSGNTASLTITGAQAEDEADYYCNSRDSSGNHLVVFGGGTKLTVL |
| | 1079 | CDRL1 | QGDSLRNYYAS |
| | 1132 | CDRL2 | YGKNNRPS |
| | 1185 | CDRL3 | NSRDSSGNHLVV |
| TC7-V-D08 | 815 | VH | QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARVARGKGAFDIWGQGTMVTVSS |

TABLE 7-continued

Table of Exemplary Anti-CD70 Binder Sequences

| Name | SEQ ID NO: | Component | Sequence |
|---|---|---|---|
| | 868 | CDRH1 | GGSFSGYYWS |
| | 921 | CDRH2 | GEINHSGSTNYNPS |
| | 974 | CDRH3 | ARVARGKGAFDI |
| | 782 | Linker | GGSGGSGGSGGS |
| | 1027 | VL | QSALTQPASVSGSPGQSITISCTGTSSDVGGYNYVSWYQQHPGKAPKLLIYEVSSRPSGVSNRFSGSKSGNTASLTISGLQAEDEADYYCNSYTNSGSWVFGGGTKVTVL |
| | 1080 | CDRL1 | TGTSSDVGGYNYVS |
| | 1133 | CDRL2 | YEVSSRPS |
| | 1186 | CDRL3 | NSYTNSGSWV |
| TC6-IV-A09 | 816 | VH | QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARVSRSRGAFDIWGQGTMVTVSS |
| | 869 | CDRH1 | GGSFSGYYWS |
| | 922 | CDRH2 | GEINHSGSTNYNPS |
| | 975 | CDRH3 | ARVSRSRGAFDI |
| | 782 | Linker | GGSGGSGGSGGS |
| | 1028 | VL | SYELTQPPSVSGSPGQSITISCTGTSSDVGVYNYVSWYQQHPGKAPKLMIYEVSHRPSGVSNRFSGSKSDNTASLTISGLQAEDEADYYCTSYSSSSTRWVFGGGTKVTVL |
| | 1081 | CDRL1 | TGTSSDVGVYNYVS |
| | 1134 | CDRL2 | YEVSHRPS |
| | 1187 | CDRL3 | TSYSSSSTRWV |
| TC7-VI-H08 | 817 | VH | QMQLVQSGAEVKKPGASVKVSCKASGYTFTSYYMHWVRQAPGQGLEWMGIINPSGGSTSYAQKFQGRVTMTRDTSTSTAYMELRSLRSDDTAVYYCARGWETNDAFDIWGQGTMVTVSS |
| | 870 | CDRH1 | GYTFTSYYMH |
| | 923 | CDRH2 | GIINPSGGSTSYAQK |
| | 976 | CDRH3 | ARGWETNDAFDI |
| | 782 | Linker | GGSGGSGGSGGS |
| | 1029 | VL | QSVLTQPPSVSGAPGQKVTISCSGSNSNVGNHYLSWYQHLPGTAPRLLIFDNNKRPSGIPDRFSGSKSGASATLDITGLQTGDEADYFCGTWDSRLNVWVFGGGTKLTVL |
| | 1082 | CDRL1 | SGSNSNVGNHYLS |
| | 1135 | CDRL2 | FDNNKRPS |
| | 1188 | CDRL3 | GTWDSRLNVWV |
| TC7-VII-G03 | 818 | VH | EVQLLESGAEVKKPGASVKVSCKASGYTFTGYYMNWVRQAPGQGLEWMAWINPNTGDTNYAQKFQGRVTMTRDTSINTAYIELSRLTSDDTAVYYCARVGDYYDRSGYYRHDAFDIWGQGTMVTVSS |
| | 871 | CDRH1 | GYTFTGYYMN |
| | 924 | CDRH2 | AWINPNTGDTNYAQK |
| | 977 | CDRH3 | ARVGDYYDRSGYYRHDAFDI |
| | 782 | Linker | GGSGGSGGSGGS |

TABLE 7-continued

Table of Exemplary Anti-CD70 Binder Sequences

| Name | SEQ ID NO: | Component | Sequence |
|---|---|---|---|
| | 1030 | VL | SSELTQDPAVSVALGQTVRITCQGDSLRSYYASWYQQKPGQAPVLVIYGKNNRPSGIPDRFSGSNSGNTATLTISGTQAMDEADYYCQAWDSSTAVFGGGTKLTVL |
| | 1083 | CDRL1 | QGDSLRSYYAS |
| | 1136 | CDRL2 | YGKNNRPS |
| | 1189 | CDRL3 | QAWDSSTAV |
| TC7-VI-H02 | 819 | VH | EVQLVQSGAEVKKPGASVKVSCKASGYTFTGYYMNWVRQAPGQGLEWMAWINPNTGDTNYAQKFQGRVTMTRDTSINTAYIELSRLTSDDTAVYYCARVGDYYDRSGYYRHDAFDIWGQGTMVTVSS |
| | 872 | CDRH1 | GYTFTGYYMN |
| | 925 | CDRH2 | AWINPNTGDTNYAQK |
| | 978 | CDRH3 | ARVGDYYDRSGYYRHDAFDI |
| | 782 | Linker | GGSGGSGGSGGS |
| | 1031 | VL | SSELTQDPAVSVALGQTVRITCQGDSLTRYYASWYQQKPGQAPVLVIYGKNNRPSGIPDRFSGSNSGNTATLTISGTQAMDEADYYCQAWDSSTAVFGTGTKVTVL |
| | 1084 | CDRL1 | QGDSLTRYYAS |
| | 1137 | CDRL2 | YGKNNRPS |
| | 1190 | CDRL3 | QAWDSSTAV |
| TC4-XVI-F01 | 820 | VH | QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDSTQDYGMDVWGQGTMVTVSS |
| | 873 | CDRH1 | GFTFSSYAMH |
| | 926 | CDRH2 | AVISYDGSNKYYADS |
| | 979 | CDRH3 | ARDSTQDYGMDV |
| | 782 | Linker | GGSGGSGGSGGS |
| | 1032 | VL | SSELTQDPAVSVALGQTVRITCQGDSLRNYYASWYQQKPGQAPVLVFYGKNNRPSGIPDRFSGSSSGNTASLTITGAQAEDEADYYCNSRDSSGNHLVVFGGGTKLTVL |
| | 1085 | CDRL1 | QGDSLRNYYAS |
| | 1138 | CDRL2 | YGKNNRPS |
| | 1191 | CDRL3 | NSRDSSGNHLVV |
| TC7-VI-B06 | 821 | VH | EVQLLESGGGVVQPGRSLRLSCAASGFTFSSYGMHWVRQAPGKGLEWVAVISYDGSNKYYADSVKGRFTISRDNSKNTLYLQMNSLRAEDTAVYYCAKGELELTNWGQGTLVTVSS |
| | 874 | CDRH1 | GFTFSSYGMH |
| | 927 | CDRH2 | AVISYDGSNKYYADS |
| | 980 | CDRH3 | AKGELELTN |
| | 782 | Linker | GGSGGSGGSGGS |
| | 1033 | VL | SYELTQPPSVSVAPGQTARITCGGNNIGSKSVHWYQQKSGQAPVLVVYDDTDRPSGTPERFSGSNSGNTATLTISGTQAMDEADYYCQAWDSSTAVFGTGTKVTVL |
| | 1086 | CDRL1 | GGNNIGSKSVH |
| | 1139 | CDRL2 | YDDTDRPS |

TABLE 7-continued

Table of Exemplary Anti-CD70 Binder Sequences

| Name | SEQ ID NO: | Component | Sequence |
|---|---|---|---|
| | 1192 | CDRL3 | QAWDSSTAV |
| TC4-XVI-H01 | 822 | VH | EVQLLESGGGVVQPGRSLRLSCAASGFTFSSYAMHWVRQAPG KGLEWVAVISYDGSNKYYADSVKGRFTISRDNSKNTLYLQMN SLRAEDTAVYYCARDSTQDYGMDVWGQGTTVTVSS |
| | 875 | CDRH1 | GFTFSSYAMH |
| | 928 | CDRH2 | AVISYDGSNKYYADS |
| | 981 | CDRH3 | ARDSTQDYGMDV |
| | 782 | Linker | GGSGGSGGSGGS |
| | 1034 | VL | SSELTQDPAVSVALGQTVRITCQGDSLRSYYASWYQQKPGQA PILVIYGKNNRPSGIPDRFSGSSSGNTASLTITGAQAEDEAD YYCNSRDSSGNLLYVFGTGTKLTVL |
| | 1087 | CDRL1 | QGDSLRSYYAS |
| | 1140 | CDRL2 | YGKNNRPS |
| | 1193 | CDRL3 | NSRDSSGNLLYV |
| TC7-VIII-G06 | 823 | VH | QVQLLESGGGLVQPGRSLRLSCAASGFTFDDYAMHWVRQAPG KGLEWVSGITWNSGSIGYADSVKGRFTISRDNAKNSLYLQMN SLRAEDTAVYYCAREVAARPFYYYGMDVWGQGTTVTVSS |
| | 876 | CDRH1 | GFTFDDYAMH |
| | 929 | CDRH2 | SGITWNSGSIGYADS |
| | 982 | CDRH3 | AREVAARPFYYYGMDV |
| | 782 | Linker | GGSGGSGGSGGS |
| | 1035 | VL | QSVLTQPPSVSVAPGKTARITCGGNNIGSKSVHWYQQKPGQA PVLVVYDDSDRPSGIPERFSGSNSGNTATLTISGTQAMDEAD YYCQAWDSSTVFGGGTKLTVL |
| | 1088 | CDRL1 | GGNNIGSKSVH |
| | 1141 | CDRL2 | YDDSDRPS |
| | 1194 | CDRL3 | QAWDSSTV |
| TC7-VII-A03 | 824 | VH | QVQLQQSGPGLVKASETLSLTCAVSGHSISSSNYWGWIRQPP GKGLEWIGSIYHSGTTYYNPSLKSRVTMSVDTSKNQFSLKLS SVTAADTAVYYCARHGSGDLGYLEYWGQGTLVTVSS |
| | 877 | CDRH1 | GHSISSSNYWG |
| | 930 | CDRH2 | GSIYHSGTTYYNPS |
| | 983 | CDRH3 | ARHGSGDLGYLEY |
| | 782 | Linker | GGSGGSGGSGGS |
| | 1036 | VL | SYELTQSPSVSVAPGKTARITCGGNNIGSKSVHWYQQKPGQA PVLVIYYDSDRPSGIPERFSGSNSGNTATLTISRVEAGDEAD YYCQVWDSSSDHPVFGGGTKVTVL |
| | 1089 | CDRL1 | GGNNIGSKSVH |
| | 1142 | CDRL2 | YYDSDRPS |
| | 1195 | CDRL3 | QVWDSSSDHPV |
| TC4-IX-G04 | 825 | VH | QVQLLESGGGVVQPGRSLRLSCAASGFTFSSYAMHWVRQAPG KGLEWVAVISYDGSNKYYADSVKGRFTISRDNSKNTLYLQMN SLRAEDTAVYYCARGLGFGSGWYEYVDAFDIWGQGTMVTVSS |
| | 878 | CDRH1 | GFTFSSYAMH |

TABLE 7-continued

Table of Exemplary Anti-CD70 Binder Sequences

| Name | SEQ ID NO: | Component | Sequence |
|---|---|---|---|
| | 931 | CDRH2 | AVISYDGSNKYYADS |
| | 984 | CDRH3 | ARGLGFGSGWYEYVDAFDI |
| | 782 | Linker | GGSGGSGGSGGS |
| | 1037 | VL | QSVLTQPASVSGSPGQSITISCTGTSSDVGSYNLVSWYQQHPGKAPKLMIYEVSKRPSGVSNRFSGSKSGNTASLTISGLQAEDEADYYCSSYRSNNTPWVFGGGTKLTVL |
| | 1090 | CDRL1 | TGTSSDVGSYNLVS |
| | 1143 | CDRL2 | YEVSKRPS |
| | 1196 | CDRL3 | SSYRSNNTPWV |
| TC7-VI-C03 | 826 | VH | QVQLVQSGGGVVQPGRSLRLSCAASGFTFSSYAMHWVRQAPGKGLEWVAVISYDGSNKYYADSVKGRFTISRDNSKNTLYLQMNSLRAEDTAVYYCARDGSEDYGMDVWGQGTTVTVSS |
| | 879 | CDRH1 | GFTFSSYAMH |
| | 932 | CDRH2 | AVISYDGSNKYYADS |
| | 985 | CDRH3 | ARDGSEDYGMDV |
| | 782 | Linker | GGSGGSGGSGGS |
| | 1038 | VL | SSELTQDPAVSVALGQTVRITCQGDSLRSYYASWYQQKPGQAPVLVIYGKNNRPSGIPDRFSGSSSGNTASLTITGAQAEDEADYYCNSRDSSGNHLVVFGGGTKLTVL |
| | 1091 | CDRL1 | QGDSLRSYYAS |
| | 1144 | CDRL2 | YGKNNRPS |
| | 1197 | CDRL3 | NSRDSSGNHLVV |
| TC7-VII-A06 | 827 | VH | QVQLVQSGGGLVQPGGSLRLSCAASGFTFSSYAMSWVRQAPGKGLEWVSAISGSGGSTYYADSVKGRFTISRDNSKNTLYLQMNSLRAEDTAVYYCAKDGYSYGGTSFDYWGQGTLVTVSS |
| | 880 | CDRH1 | GFTFSSYAMS |
| | 933 | CDRH2 | SAISGSGGSTYYADS |
| | 986 | CDRH3 | AKDGYSYGGTSFDY |
| | 782 | Linker | GGSGGSGGSGGS |
| | 1039 | VL | QSALTQPASVSGSPGQSITISCTGTSSDVGGYDYVSWYQQHPGKAPKLMIYEVSNRPSGVSNRFSGSKSGNTASLTISGLQAEDEADYYCSSYASSGSLLFGGGTKVTVL |
| | 1092 | CDRL1 | TGTSSDVGGYDYVS |
| | 1145 | CDRL2 | YEVSNRPS |
| | 1198 | CDRL3 | SSYASSGSLL |
| TC7-V-H07 | 828 | VH | EVQLVESGGGVVQPGRSLRLSCAASGFTFSNYAMHWVRQAPGKGLEWVAIISYDGTNKYYADSVKGRFTISRDNAKNSLYLQMNSLRDEDTAVYYCARDPAYGSYYYYGMDVWGQGTTVTVSS |
| | 881 | CDRH1 | GFTFSNYAMH |
| | 934 | CDRH2 | AIISYDGTNKYYADS |
| | 987 | CDRH3 | ARDPAYGSYYYYGMDV |
| | 782 | Linker | GGSGGSGGSGGS |
| | 1040 | VL | QSVLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGVVFGGGTKVTVL |

TABLE 7-continued

Table of Exemplary Anti-CD70 Binder Sequences

| Name | SEQ ID NO: | Component | Sequence |
|---|---|---|---|
| | 1093 | CDRL1 | SGSSSNIGSNTVN |
| | 1146 | CDRL2 | YSNNQRPS |
| | 1199 | CDRL3 | AAWDDSLNGVV |
| TC7-VII-E11 | 829 | VH | QVQLVQSGGGVVQPGRSLRLSCAASGFTFSSYAMHWVRQAPGKGLEWVAVISYDGSNKYYADSVKGRFTISRDNSKNTLYLQMNSLRAEDTAVYYCARDSSGYYYGSDAFDIWGQGTMVTVSS |
| | 882 | CDRH1 | GFTFSSYAMH |
| | 935 | CDRH2 | AVISYDGSNKYYADS |
| | 988 | CDRH3 | ARDSSGYYYGSDAFDI |
| | 782 | Linker | GGSGGSGGSGGS |
| | 1041 | VL | SYELTQPPSVSVALGQTVRITCQGDSLRSYYASWYQQKPGQAPVLVIYGKNNRPSGIPDRFSGSSSGNTASLTITGAQAEDEADYYCNSRDSSGNPWVFGGGTKVTVL |
| | 1094 | CDRL1 | QGDSLRSYYAS |
| | 1147 | CDRL2 | YGKNNRPS |
| | 1200 | CDRL3 | NSRDSSGNPWV |
| TC4-XII-A11 | 830 | VH | QVQLVQSGGGVVQPGRSLRLSCAASGFTFSSYAMHWVRQAPGKGLEWVAVISYDGSNKYYADSVKGRFTISRDNSKNTLYLQMNSLRAEDTAVYYCARDGSEDYGMDVWGQGTTVTVSS |
| | 883 | CDRH1 | GFTFSSYAMH |
| | 936 | CDRH2 | AVISYDGSNKYYADS |
| | 989 | CDRH3 | ARDGSEDYGMDV |
| | 782 | Linker | GGSGGSGGSGGS |
| | 1042 | VL | SSELTQDPAVSVALGQTVRITCQGDSLRSYYASWYQQKPGQAPVLVIYGKNNRPSGIPDRFSGSSSGNTASLTITGAQAEDEADYYCNSRDSSGNHLVVFGGGTKVTVL |
| | 1095 | CDRL1 | QGDSLRSYYAS |
| | 1148 | CDRL2 | YGKNNRPS |
| | 1201 | CDRL3 | NSRDSSGNHLVV |
| TC6-I-F03 | 831 | VH | QVQLVQSGAEVKKPGASVKVSCKASGYTFTGYYMNWVRQAPGQGLEWMAWINPNTGDTNYAQKFQGRVTMTRDTSINTAYIELSRLTSDDTAVYYCARVGDYYDRSGYYRHDAFDIWGQGTMVTVSS |
| | 884 | CDRH1 | GYTFTGYYMN |
| | 937 | CDRH2 | AWINPNTGDTNYAQK |
| | 990 | CDRH3 | ARVGDYYDRSGYYRHDAFDI |
| | 782 | Linker | GGSGGSGGSGGS |
| | 1043 | VL | SSELTQDPAVSVALGQTVRITCQGDSLRSYYASWYQQKPGQAPVLVIYGKNNRPSGIPDRFSGSNSGNTATLTISGTQAMDEADYYCQAWDSSTVFGGGTKVTVL |
| | 1096 | CDRL1 | QGDSLRSYYAS |
| | 1149 | CDRL2 | YGKNNRPS |
| | 1202 | CDRL3 | QAWDSSTV |

TABLE 7-continued

Table of Exemplary Anti-CD70 Binder Sequences

| Name | SEQ ID NO: | Component | Sequence |
|---|---|---|---|
| TC4-III-A04 | 832 | VH | QVQLVQSGAEVKKPGASVKVSCKASGYTFTGYYMNWVRQAPGQGLEWMAWINPNTGDTNYAQKFQGRVTMTRDTSINTAYIELSRLTSDDTAVYYCARVGDYYDRSGYYRHDAFDIWGQGTMVTVSS |
| | 885 | CDRH1 | GYTFTGYYMN |
| | 938 | CDRH2 | AWINPNTGDTNYAQK |
| | 991 | CDRH3 | ARVGDYYDRSGYYRHDAFDI |
| | 782 | Linker | GGSGGSGGSGGS |
| | 1044 | VL | SSELTQDPAVSVALGQTVRITCQGDSLRSYYASWYQQKPGQAPVLVIYGKNNRPSGIPDRFSGSSSGNTASLTITGAQAEDEADYYCQAWDSSTGVFGGGTKVTVL |
| | 1097 | CDRL1 | QGDSLRSYYAS |
| | 1150 | CDRL2 | YGKNNRPS |
| | 1203 | CDRL3 | QAWDSSTGV |
| TC7-I-E11 | 833 | VH | QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARSRRPYWYFDLWGRGTLVTVSS |
| | 886 | CDRH1 | GGSFSGYYWS |
| | 939 | CDRH2 | GEINHSGSTNYNPS |
| | 992 | CDRH3 | ARSRRPYWYFDL |
| | 782 | Linker | GGSGGSGGSGGS |
| | 1045 | VL | QSVLTQPPSVSGAPGQRVTISCTGSSSNIGAGYDVHWYQQLPGTAPKLLIYGDSNRPSGVPDRFSGSGSGTSASLAITGLQAEDEGDYYCQSFDSNLSRYVFGAGTKLTVL |
| | 1098 | CDRL1 | TGSSSNIGAGYDVH |
| | 1151 | CDRL2 | YGDSNRPS |
| | 1204 | CDRL3 | QSFDSNLSRYV |
| TC7-I-D07 | 834 | VH | QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARVSRSRGAFDIWGQGTMVTVSS |
| | 887 | CDRH1 | GGSFSGYYWS |
| | 940 | CDRH2 | GEINHSGSTNYNPS |
| | 993 | CDRH3 | ARVSRSRGAFDI |
| | 782 | Linker | GGSGGSGGSGGS |
| | 1046 | VL | QSALTQPASVSGSPGQSITISCTGTNSDVGAYNYVSWYQQHPGKAPKLMIYEVTNRPSGVSNRFSGSKSGNTASLTISGLQAEDEADYYCSSYTSSGTWVFGGGTKLTVL |
| | 1099 | CDRL1 | TGTNSDVGAYNYVS |
| | 1152 | CDRL2 | YEVTNRPS |
| | 1205 | CDRL3 | SSYTSSGTWV |
| TC7-IV-H08 | 835 | VH | QMQLVQSGGGLVQPGRSLRLSCAASGFTFDDYAMHWVRQAPGKGLEWVAVISYDGSNKYYADSVKGRFTISRDNSKNTLYLQMNSLRAEDTAVYYCARSSYDFWSGYPKDMDVWGKGTTVTVSS |
| | 888 | CDRH1 | GFTFDDYAMH |
| | 941 | CDRH2 | AVISYDGSNKYYADS |

TABLE 7-continued

| Table of Exemplary Anti-CD70 Binder Sequences | | | |
|---|---|---|---|
| Name | SEQ ID NO: | Component | Sequence |
| | 994 | CDRH3 | ARSSYDFWSGYPKDMDV |
| | 782 | Linker | GGSGGSGGSGGS |
| | 1047 | VL | SSELTQDPAVSVALGQTVRITCQGDSLRSYYASWYQQKPGQA<br>PVLVIYGKNNRPSGIPDRFSGSSSGNTASLTITGAQAEDEAD<br>YYCNSRDSSGNHLVVFGGGTKLTVL |
| | 1100 | CDRL1 | QGDSLRSYYAS |
| | 1153 | CDRL2 | YGKNNRPS |
| | 1206 | CDRL3 | NSRDSSGNHLVV |

TABLE 8

| Table of Exemplary Anti-CD70 scFv Sequences | | |
|---|---|---|
| Name | SEQ ID NO: | Sequence |
| 15F8D<br>9 VH VL | 1207 | EVQLVESGGGVVRPGGSLRLSCAASGFTFDDYGVSWVRQAPGRGLEWV<br>SGINWNGGSTAYADSVKGRFTISRDSAKNSLYLQMDSLRAEDTALYYCA<br>REEGSYYVWYFDIWGRGTLVTVSS**GSTSGSGKPGSGEGSTKG**DIQMTQ<br>SPSSLSASVGDRVTITCRPSQSISNYLNWYQQKPGKAPKVLIYASFILQSG<br>VPSRFGGSGSGTDFTLTISSLQPEDFATYYCQQSYSNPFTFGPGTKVDIK |
| 15F8D<br>9 VL VH | 1208 | DIQMTQSPSSLSASVGDRVTITCRPSQSISNYLNWYQQKPGKAPKVLIYA<br>SFILQSGVPSRFGGSGSGTDFTLTISSLQPEDFATYYCQQSYSNPFTFGPGT<br>KVDIK**GSTSGSGKPGSGEGSTKG**EVQLVESGGGVVRPGGSLRLSCAAS<br>GFTFDDYGVSWVRQAPGRGLEWVSGINWNGGSTAYADSVKGRFTISRD<br>SAKNSLYLQMDSLRAEDTALYYCAREEGSYYVWYFDIWGRGTLVTVSS |
| 15F8D<br>9 VH | 1248 | EVQLVESGGGVVRPGGSLRLSCAASGFTFDDYGVSWVRQAPGRGLEWV<br>SGINWNGGSTAYADSVKGRFTISRDSAKNSLYLQMDSLRAEDTALYYCA<br>REEGSYYVWYFDIWGRGTLVTVSS |
| Linker | 1237 | GSTSGSGKPGSGEGSTKG |
| 15F8D<br>9 VH VL | 1249 | DIQMTQSPSSLSASVGDRVTITCRPSQSISNYLNWYQQKPGKAPKVLIYA<br>SFILQSGVPSRFGGSGSGTDFTLTISSLQPEDFATYYCQQSYSNPFTFGP<br>GTKVDIK |
| 9A11E<br>8 VH VL | 1209 | QVQLVESGGGVVQPGRSLRLSCAASGFTFSNYGMYWVRQAPGKGLEW<br>VAVIWYDGSKKYYGDSVKGRFTISRDNSKNTLYLQMNSLRAEDTAVYY<br>CARDEDTVMASFDYWGQGTLVTVSS**GSTSCSGKPGSGEGSTKG**DIQLT<br>QSPSFLSASVGDRVTITCRASQDISIYLAWYQQKPGKAPQLLIYAASTLQS<br>GVPSRFSGSGSGTEFTLTISSLQPEDFATYSCQQLNSYPITFGGGTKVEIK |
| 9A11E<br>8 VL VH | 1210 | DIQLTQSPSFLSASVGDRVTITCRASQDISIYLAWYQQKPGKAPQLLIYAA<br>STLQSGVPSRFSGSGSGTEFTLTISSLQPEDFATYSCQQLNSYPITFGGGTK<br>VEIK**GSTSGSGKPGSGEGSTKG**QVQLVESGGGVVQPGRSLRLSCAASG<br>FTFSNYGMYWVRQAPGKGLEWVAVIWYDGSKKYYGDSVKGRFTISRD<br>NSKNTLYLQMNSLRAEDTAVYYCARDEDTVMASFDYWGQGTLVTVSS |
| 9A11E<br>8 VH | 1250 | QVQLVESGGGVVQPGRSLRLSCAASGFTFSNYGMYWVRQAPGKGLEW<br>VAVIWYDGSKKYYGDSVKGRFTISRDNSKNTLYLQMNSLRAEDTAVYY<br>CARDEDTVMASFDYWGQGTLVTVSS |
| Linker | 1237 | GSTSGSGKPGSGEGSTKG |
| 9A11E | 1251 | DIQLTQSPSFLSASVGDRVTITCRASQDISIYLAWYQQKPGKAPQLLIYAA |

TABLE 8-continued

Table of Exemplary Anti-CD70 scFv Sequences

| Name | SEQ ID NO: | Sequence |
|---|---|---|
| 8 VL | | STLQSGVPSRFSGSGSGTEFTLTISSLQPEDFATYSCQQLNSYPITFGGGT KVEIK |
| 9A1H6 VH VL | 1211 | QVQLVQSGAEVKKPGASVKVSCKASGYSFTGYYMHWVRQAPGQGLEW MGWINPKSGGTSYAQKFQGRVTMTRDTSMSTVYMELTRLRADDTAVY YCARLYYSGWYGDYWGQGTLVTVSS**GSTSGSGKPGSGEGSTKG**DIQM TQSPSSLSASVGDRVTITCQASQDINNYLNWYQQKPGKVPNLLIYDASNEL TGVPSRFSGSGSGTDFTFTISSLQPEDIATYYCQQYNNPPITFGQGTRLEIK |
| 9A1H6 VL VH | 1212 | DIQMTQSPSSLSASVGDRVTITCQASQDINNYLNWYQQKPGKVPNLLIYD ASNLETGVPSRFSGSGSGTDFTFTISSLQPEDIATYYCQQYNNPPITFGQGT RLEIK**GSTSGSGKPGSGEGSTKG**QVQLVQSGAEVKKPGASVKVSCKAS GYSFTGYYMHWVRQAPGQGLEWMGWINPKSGGTSYAQKFQGRVTMT RDTSMSTVYMELTRLRADDTAVYYCARLYYSGWYGDYWGQGTLVTVSS |
| 4G7E8 VH VL | 1213 | QVQLVESGGGVVQPGRSLRLSCAASGFTFSSYGLHWVRQAPGKGLDWV AVIWYDGSNKYYVDSVKGRFTISRDNSMNTLFLQMNSLRAEDTAVYYC ARDEAAAGAFDIWGQGTMVTVSS**GSTSGSGKPGSGEGSTKG**DIQLTQ SPSFLSASVGDRVTITCRASQGISSYLAWYQQKPGKAPKLLIYAASTLQS GVPSRFSGSGSGTEFTLTISSLQPEDFATYYCQQLNYYSITFGQGTRLEIK |
| 4G7E8 VL VH | 1214 | DIQLTQSPSFLSASVGDRVTITCRASQGISSYLAWYQQKPGKAPKLLIYAA STLQSGVPSRFSGSGSGTEFTLTISSLQPEDFATYYCQQLNYYSITFGQGT RLEIK**GSTSGSGKPGSGEGSTKG**QVQLVESGGGVVQPGRSLRLSCAAS GFTFSSYGLHWVRQAPGKGLDWVAVIWYDGSNKYYVDSVKGRFTISRD NSMNTLFLQMNSLRAEDTAVYYCARDEAAAGAFDIWGQGTMVTVSS |
| 2F1F7 VH VL | 1215 | EVQLVESGGVVVQPGGSLRLSCAASGFTFDDYTMHWVRQAPGKGLEW VSLVSWDGGSTYYADSVKGRFTISRDNSKKFLYLQMNRLRTEDTALYF CAIDRAYRPYYYYHMDVWGKGTTVTVSS**GSTSGSGKPGSGEGSTKG**D IQMTQSPSSLSASVGDRVTITCQASQDISNYLNWYQQKPGKAPKLLIYDA SNLETGVPSRFSGSGSGTDFTFTISSLQPEDIATYYCQQYDNLPITFGQGT RLEIK |
| 2F1F7 VL VH | 1216 | GDIQMTQSPSSLSASVGDRVTITCQASQDISNYLNWYQQKPGKAPKLLIY DASNLETGVPSRFSGSGSGTDFTFTISSLQPEDIATYYCQQYDNLPITFGQ GTRLEIK**GSTSGSGKPGSGEGSTK**EVQLVESGGVVVQPGGSLRLSCAAS GFTFDDYTMHWVRQAPGKGLEWVSLVSWDGGSTYYADSVKGRFTISR DNSKKFLYLQMNRLRTEDTALYFCAIDRAYRPYYYYHMDVWGKGTTVTVSS |
| 1E3D9 VH VL | 1217 | QLQLQESGPGLVKPSETLSLTCTVSGASITSTSYYWNWIRQPPGKGLEWI GRISYSGSTYYNPSLKSRVTISVDTSKNQFSLKLSSVTAADTAVYYCARQI RYWNFPDTFDIWGQGTMVTVSS**GSTSGSGKPGSGEGSTKG**EIVMTQSP ATLSVSPGERATLSCRASQSLNSNLAWYQQKPAQAPRLLIYGASTRATGI PARFSGSGSGTEFTLTISSLQSEDFAVYYCQQYDNWPLTFGGGTKVEIK |
| 1E3D9 VL VH | 1218 | EIVMTQSPATLSVSPGERATLSCRASQSLNSNLAWYQQKPAQAPRLLIYG ASTRATGIPARFSGSGSGTEFTLTISSLQSEDFAVYYCQQYDNWPLTFGG GTKVEIK**GSTSGSGKPGSGEGSTKG**QLQLQESGPGLVKPSETLSLTCTV SGASITSTSYYWNWIRQPPGKGLEWIGRISYSGSTYYNPSLKSRVTISVDT SKNQFSLKLSSVTAADTAVYYCARQIRYWNFPDTFDIWGQGTMVTVSS |
| 13C1G 6 VH- | 1219 | EVQLVESGGGLVKPGGSLRLSCAASGFTFSSYSMNWVRQAPGKGLEWV SLISSSSRPIYYADSVKGRFTVSRDNAKKSLYLLLNSLRAEDTAVYYCAR |

TABLE 8-continued

Table of Exemplary Anti-CD70 scFv Sequences

| Name | SEQ ID NO: | Sequence |
|---|---|---|
| linker-<br>VL1 | | GDYSNYFYFDYWGQGTLVTVSS**GSTSGSGKPGSGEGSTKG**EIVLTQSP<br>ATLSLSPGERATLSCRASQSVRSSYLAWYQQKPGQPPRLLIFGASSRATGI<br>PDRFSGSGSGTDFTLTISRLEPEDFAVYYCQQYGDSPALTFGGGTKVEIK |
| 13C1G<br>6 VL1<br>VH | 1220 | EIVLTQSPATLSLSPGERATLSCRASQSVRSSYLAWYQQKPGQPPRLLIFG<br>ASSRATGIPDRFSGSGSGTDFTLTISRLEPEDFAVYYCQQYGDSPALTFGG<br>GTKVEIK**GSTSGSGKPGSGEGSTKG**EVQLVESGGGLVKPGGSLRLSCA<br>ASGFTFSSYSMNWVRQAPGKGLEWVSLISSSSRFIYYADSVKGRFTVSRD<br>NAKKSLYLLLNSLRAEDTAVYYCARGDYSNYFYFDYWGQGTLVTVSS |
| 13C1G<br>6 VH-<br>linker-<br>VL2 | 1221 | EVQLVESGGGLVKPGGSLRLSCAASGFTFSSYSMNWVRQAPGKGLEWV<br>SLISSSSRFIYYADSVKGRFTVSRDNAKKSLYLLLNSLRAEDTAVYYCAR<br>GDYSNYFYFDYWGQGTLVTVSS**GSTSGSGKPGSGEGSTKG**DIQMTQSP<br>SNLSASVGDRVTITCRASQSISSWLAWYQQKPGKAPKLLIYKASSLESGV<br>PSRFSGSGSGTEFTLTISSLQPDDFAGYYCQHYNTYSPTFGQGTKVEIK |
| 13C1G<br>6 VL2<br>VH | 1222 | DIQMTQSPSNLSASVGDRVTITCRASQSISSWLAWYQQKPGKAPKLLIYK<br>ASSLESGVPSRFSGSGSGTEFTLTISSLQPDDFAGYYCQHYNTYSPTFGQG<br>TKVEIK**GSTSGSGKPGSGEGSTKG**EVQLVESGGGLVKPGGSLRLSCAAS<br>GFTFSSYSMNWVRQAPGKGLEWVSLISSSSRFIYYADSVKGRFTVSRDN<br>AKKSLYLLLNSLRAEDTAVYYCARGDYSNYFYFDYWGQGTLVTVSS |
| 13G6E<br>8 VH VL | 1246 | QVQLVESGGGVVQPGKSLRLSCAASGFTFSNYGIHWVRQAPGKGLEWV<br>AVIWYDGSYKYYADSVKGRFTISRDNSKNTLYLQMNSLRAEDTALYYC<br>ARDTVDTYGSFDYWGQGTLVTVSS**GSTSGSGKPGSGEGSTKG**DIQLTQ<br>SPSFLSASVGDRVTITGRASQGISSYLAWYQQKPGKAPNLLIYAASTLQS<br>GVPSRFSGSGSGTEFTLTISSLQPEDFATYYCQQHNRYPITFGQGTRLEIK |
| 13G6E<br>8 VL VH | 1247 | DIQLTQSPSFLSASVGDRVTITGRASQGISSYLAWYQQKPGKAPNLLIYA<br>ASTLQSGVPSRFSGSGSGTEFTLTISSLQPEDFATYYCQQHNRYPITFGQG<br>TRLEIK**GSTSGSGKPGSGEGSTKG**QVQLVESGGGVVQPGKSLRLSCAAS<br>GFTFSNYGIHWVRQAPGKGLEWVAVIWYDGSYKYYADSVKGRFTISRD<br>NSKNTLYLQMNSLRAEDTALYYCARDTVDTYGSFDYWGQGTLVTVSS |
| 13G6E<br>8 VH | 1252 | QVQLVESGGGVVQPGKSLRLSCAASGFTFSNYGIHWVRQAPGKGLEWV<br>AVIWYDGSYKYYADSVKGRFTISRDNSKNTLYLQMNSLRAEDTALYYC<br>ARDTVDTYGSFDYWGQGTLVTVSS |
| Linker | 1237 | GSTSGSGKPGSGEGSTKG |
| 13G6E<br>8 VL | 1253 | DIQLTQSPSFLSASVGDRVTITGRASQGISSYLAWYQQKPGKAPNLLIYA<br>ASTLQSGVPSRFSGSGSGTEFTLTISSLQPEDFATYYCQQHNRYPITFGQG<br>TRLEIK |

VH domains are shown in gray. VL domains are shown in black. Linkers are bold and underlined with dotted lines.

TABLE 9

Table of Exemplary Anti-CD70 sdAb Sequences

| Name | SEQ ID NO: | Sequence |
|---|---|---|
| CD70 R2P16D9<br>70-001 Wild<br>Type Sequences | 618 | QVQLQESGGGLVQPGGSLRLSCVAS**GSIFSIAR**MNWYRQAPGK<br>QRELVAI**LNRAGRT**DYADSVKGRFTISSDNAKTTVYLQMNSLK<br>PEDTALYYC**NLQTISYHDF**WGQGTQVTVSS |
| CD70 R2P16D9<br>70-001 h7 | 1224 | EVQLVESGGGLVQPGGSLRLSCAAS**GSIFSIAR**MNWYRQAPGK<br>QRELVAI**LNRAGRT**DYADSVKGRFTISSDNAKNTLYLQMNSLR<br>PEDTAVYYC**NLQTISYHDF**WGQGTQVTVSS |

TABLE 9-continued

Table of Exemplary Anti-CD70 sdAb Sequences

| Name | SEQ ID NO: | Sequence |
|---|---|---|
| CD70 R2P16D9 70-001 h9 | 1225 | EVQLVESGGGLVQPGGSLRLSCAAS**GSIFSIAR**MNWYRQAPGKQRELVSI**LNRAGRT**DYADSVKGRFTISRDNAKNTLYLQMNSLRPEDTAVYYC**NLQTISYHDF**WGQGTQVTVSS |
| CD70 R2P16D9 70-001 h10 | 1226 | EVQLVESGGGLVQPGGSLRLSCAAS**GSIFSIAR**MNWYRQAPGKQRELVSI**LNRAGRT**YYADSVKGRFTISRDNAKNTLYLQMNSLRPEDTAVYYC**NLQTISYHDF**WGQGTQVTVSS |
| CD70 R2P16D9 70-001 h11 | 1227 | EVQLVESGGGLVQPGGSLRLSCAAS**GSIFSIAR**MSWYRQAPGKQRELVSI**LNRAGRT**YYADSVKGRFTISRDNAKNTLYLQMNSLRPEDTAVYYC**NLQTISYHDF**WGQGTQVTVSS |

CDRs are bold and underlined.

TABLE 10

Table of Exemplary PD-1 Sequences

| Name | SEQ ID NO: | Sequence |
|---|---|---|
| PD1CD28 fusion protein/switch-receptor, amino acid sequence | 1239 | MQIPQAPWPVVWAVLQLGWRPGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERRAEVPTAHPSPSPRPAGQFQTLVVGVVGGLLGSLVLLVWVLAVIRSKRSRLLHSDYMNMTPRRPGPTRKHYQPYAPPRDFAAYRS |
| PD1CD28 fusion protein/switch-receptor, amino acid sequence without the signal peptide | 1244 | PGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERRAEVPTAHPSPSPRPAGQFQTLVVGVVGGLLGSLVLLVWVLAVIRSKRSRLLHSDYMNMTPRRPGPTRKHYQPYAPPRDFAAYRS |
| PD-1 Signal Peptide | 1256 | MQIPQAPWPVVWAVLQLGWR |
| PD-1 N-Loop | 1257 | PGWFLDSPDRPWNP |
| PD-1 IgV | 1258 | PTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVT |
| PD-1 Stalk | 1259 | ERRAEVPTAHPSPSPRPAGQFQTLV |
| PD-1 Trans membrane domain | 1263 | VGVVGGLLGSLVLLVWVLAVI |
| CD28 IC | 1260 | RSKRSRLLHSDYMNMTPRRPGPTRKHYQPYAPPRDFAAYRS |

TABLE 11

Table of Exemplary IL-15 or IL-15R Sequences

| Name | SEQ ID NO: | Sequence |
|---|---|---|
| IL-15 without signal peptide | 1242 | GIHVFILGCFSAGLPKTEANWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS |
| IL-15 protein sequence | 1245 | MRISKPHLRSISIQCYLCLLLNSHFLTEAGIHVFILGCFSAGLPKTEANWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS |
| IL-15 Signal Peptide | 1246 | MRISKPHLRSISIQCYLCLLLNSHFLTEA |

TABLE 11-continued

Table of Exemplary IL-15 or IL-15R Sequences

| Name | SEQ ID NO: | Sequence |
|---|---|---|
| IL-15Rα full-length protein sequence | 1247 | MAPRRARGCRTLGLPALLLLLLLRPPATRGITCPPPMSVEHADIWVKSYSLYSRERYICNSGFKRKAGTSSLTECVLNKATNVAHWTTPSLKCIRDPALVHQRPAPPSTVTTAGVTPQPESLSPSGKEPAASSPSSNNTAATTAAIVPGSQLMPSKSPSTGTTEISSHESSHGTPSQTTAKNWELTASASHQPPGVYPQGHSDTTVAISTSTVLLCGLSAVSLLACYLKSRQTPPLASVEMEAMEALPVTWGTSSRDEDLENCSHHL |
| IL-15Rα intracellular domain | 1248 | KSRQTPPLASVEMEAMEALPVTWGTSSRDEDLENCSHHL |
| Soluble IL-15Ra (sIL-15Ra) | 1249 | ITCPPPMSVEHADIWVKSYSLYSRERYICNSGFKRKAGTSSLTECVLNKATNVAHWTTPSLKCIRDPALVHQRPAPPSTVTTAGVTPQPESLSPSGKEPAASSPSSNNTAATTAAIVPGSQLMPSKSPSTGTTEISSHESSHGTPSQTTAKNWELTASASHQPPGVYPQGHSDTT |
| IL-15 Sushi domain | 1250 | ITCPPPMSVEHADIWVKSYSLYSRERYICNSGFKRKAGTSSLTECVLNKATNVAHWTTPSLKCIR |
| IL-15Rα region downstream of Sushi domain | 1251 | DPALVHQRPAPPSTVTTAGVTPQPESLSPSGKEPAASSPSSNNTAATTAAIVPGSQLMPSKSPSTGTTEISSHESSHGTPSQTTAKNWELTASASHQPPGVYPQGHSDTTVAISTSTVLLCGLSAVSLLACYLKSRQTPPLASVEMEAMEALPVTWGTSSRDEDLENCSHHL |
| IL-15Rα transmembrane domain | 1252 | VAISTSTVLLCGLSAVSLLACYL |
| IL-15-IL 15Rα fusion | 1253 | GIHVFILGCFSAGLPKTEANWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSSGGGSGGGGSGGGGSGGGGSGGGSLQITCPPPMSVEHADIWVKSYSLYSRERYICNSGFKRKAGTSSLTECVLNKATNVAHWTTPSLKCIRDPALVHQRPAPPSTVTTAGVTPQPESLSPSGKEPAASSPSSNNTAATTAAIVPGSQLMPSKSPSTGTTEISSHESSHGTPSQTTAKNWELTASASHQPPGVYPQGHSDTTVAISTSTVLLCGLSAVSLLACYLKSRQTPPLASVEMEAMEALPVTWGTSSRDEDLENCSHHL |
| PD-1-CD28-IL-15Rα fusion | 1254 | PGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERRAEVPTAHPSPSPRPAGQFQTLVVGVVGGLLGSLVLLVWVLAVIRSKRSRLLHSDYMNMTPRRPGPTRKHYQPYAPPRDFAAYRSKSRQTPPLASVEMEAMEALPVTWGTSSRDEDLENCSHHL |
| PD-1-CD28-IL-15Rα fusion with PD-1 Signal Peptide | 1262 | MQIPQAPWPVVWAVLQLGWRPGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERRAEVPTAHPSPSPRPAGQFQTLVVGVVGGLLGSLVLLVWVLAVIRSKRSRLLHSDYMNMTPRRPGPTRKHYQPYAPPRDFAAYRSKSRQTPPLASVEMEAMEALPVTWGTSSRDEDLENCSHHL |

TABLE 12

Table of Exemplary Construct Sequences

| Construct | SEQ ID NO: | Component | Sequence |
|---|---|---|---|
| 70-001 TFP | 1233 | Full Sequence | MLLLVTSLLLCELPHPAFLLIPQVQLQESGGGLVQPGGSLRLSCVASGSIFSIARMNWYRQAPGKQRELVAILNRAGRTDYADSVKGRFTISSDNAKTTVYLQMNSLKPEDTALYYCNLQTISYHDFWGQGTQVTVSSAAAGGGGSGGGGSGGGGSLEDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRI |

TABLE 12-continued

Table of Exemplary Construct Sequences

| Construct | SEQ ID NO: | Component | Sequence |
|---|---|---|---|
| | 1234 | GM-CSFRa Signal Peptide | MLLLVTSLLLCELPHPAFLLIP |
| | 618 | 70-001 | QVQLQESGGGLVQPGGSLRLSCVASGSIFSIARMNWYRQAPGKQRELVAILNRAGRTDYADSVKGRFTISSDNAKTTVYLQMNSLKPEDTALYYCNLQTISYHDFWGQGTQVTVSS |
| | 692 | Linker | AAAGGGGSGGGGSGGGGSLE |
| | 1235 | CD3e | DGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRI |
| C10 TFP | 1236 | Full Sequence | MLLLVTSLLLCELPHPAFLLIPQSALTQPRSVSGSPGQSVTISCTGTSSDVGGYNYVSWYQQHPGKAPKLMIYDVTNRPSGVPDRFSASKSDNTATLTVSGVQAEDEADYYCSSYAGSHELFGGGTKLTVLGSTSGSGKPGSGEGSTKGEVQLVQSGAEVKKPGESLKISCKGSGYSFTSYWIGWVRQMPGKGLEWMGIIYPGDSDTRYSPSFQGQVTISADKSISTAYLQWSSLKASDTAMYYCAISRTESYVMDVWGQGTTVTVSSAAAGGGGSGGGGSGGGGSLEDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRI |
| | 1234 | GM-CSFRa Signal Peptide | MLLLVTSLLLCELPHPAFLLIP |
| | 1012 | C10 vL | QSALTQPRSVSGSPGQSVTISCTGTSSDVGGYNYVSWYQQHPGKAPKLMIYDVTNRPSGVPDRFSASKSDNTATLTVSGVQAEDEADYYCSSYAGSHELFGGGTKLTVL |
| | 1237 | Linker | GSTSGSGKPGSGEGSTKG |
| | 800 | C10 vH | EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCAISRTESYVMDVWGQGTTVTVSS |
| | 692 | Linker | AAAGGGGSGGGGSGGGGSLE |
| | 1235 | CD3e | DGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRI |
| C10 TFP + PD1-CD28 | 1264 | Full Sequence | MLLLVTSLLLCELPHPAFLLIPQSALTQPRSVSGSPGQSVTISCTGTSSDVGGYNYVSWYQQHPGKAPKLMIYDVTNRPSGVPDRFSASKSDNTATLTVSGVQAEDEADYYCSSYAGSHELFGGGTKLTVLGSTSGSGKPGSGEGSTKGEVQLVQSGAEVKKPGESLKISCKGSGYSFTSYWIGWVRQMPGKGLEWMGIIYPGDSDTRYSPSFQGQVTISADKSISTAYLQWSSLKASDTAMYYCAISRTESYVMDVWGQGTTVTVSSAAAGGGGSGGGGSGGGGSLEDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRIGSGEGRGSLLTCGDVEENPGPGMQIPQAPWPVVWAVLQLGWRPGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERRAEVPTAHPSPSPRPAGQFQTLVVGVVGGLLGSLVLLVWVLAVIRSKRSRLLHSDYMNMTPRRPGPTRKHYQPYAPPRDFAAYRS |
| | 1234 | GM-CSFRa Signal Peptide | MLLLVTSLLLCELPHPAFLLIP |

TABLE 12-continued

Table of Exemplary Construct Sequences

| Construct | SEQ ID NO: | Component | Sequence |
|---|---|---|---|
| | 1012 | C10 vL | QSALTQPRSVSGSPGQSVTISCTGTSSDVGGYNYVSWYQQH PGKAPKLMIYDVTNRPSGVPDRFSASKSDNTATLTVSGVQA EDEADYYCSSYAGSHELFGGGTKLTVL |
| | 1237 | Linker | GSTSGSGKPGSGEGSTKG |
| | 800 | C10 vH | EVQLVQSGAEVKKPGESLKISCKGSGYSFTSYWIGWVRQMP GKGLEWMGIIYPGDSDTRYSPSFQGQVTISADKSISTAYLQ WSSLKASDTAMYYCAISRTESYVMDVWGQGTTVTVSS |
| | 692 | Linker | AAAGGGGSGGGGSGGGGSLE |
| | 1235 | CD3e | DGNEEMGGITQTPYKVSISGTTVILTCPQYPGSEILWQHND KNIGGDEDDKNIGSDEDHLSLKEFSELEQSGYYVCYPRGSK PEDANFYLYLRARVCENCMEMDVMSVATIVIVDICITGGLL LLVYYWSKNRKAKAKPVTRGAGAGGRQRGQNKERPPPVPNP DYEPIRKGQRDLYSGLNQRRI |
| | 1238 | T2A | GSGEGRGSLLTCGDVEENPGPG |
| | 1239 | PD-1 CD28 Fusion protein | MQIPQAPWPVVWAVLQLGWRPGWFLDSPDRPWNPPTFSPAL LVVTEGDNATFTCSFSNTSESFVLNWYRMSPSNQTDKLAAF PEDRSQPGQDCRFRVTQLPNGRDFHMSVVRARRNDSGTYLC GAISLAPKAQIKESLRAELRVTERRAEVPTAHPSPSPRPAG QFQTLVVGVVGGLLGSLVLLVWVLAVIRSKRSRLLHSDYMN MTPRRPGPTRKHYQPYAPPRDFAAYRS |
| C10 TFP + IL15-IL15Ra | 1240 | Full Sequence | MLLLVTSLLLCELPHPAFLLIPQSALTQPRSVSGSPGQSVT ISCTGTSSDVGGYNYVSWYQQHPGKAPKLMIYDVTNRPSGV PDRFSASKSDNTATLTVSGVQAEDEADYYCSSYAGSHELFG GGTKLTVLGSTSGSGKPGSGEGSTKGEVQLVQSGAEVKKPG ESLKISCKGSGYSFTSYWIGWVRQMPGKGLEWMGIIYPGDS DTRYSPSFQGQVTISADKSISTAYLQWSSLKASDTAMYYCA ISRTESYVMDVWGQGTTVTVSSAAAGGGGSGGGGSGGGGSL EDGNEEMGGITQTPYKVSISGTTVILTCPQYPGSEILWQHN DKNIGGDEDDKNIGSDEDHLSLKEFSELEQSGYYVCYPRGS KPEDANFYLYLRARVCENCMEMDVMSVATIVIVDICITGGL LLLVYYWSKNRKAKAKPVTRGAGAGGRQRGQNKERPPPVPN PDYEPIRKGQRDLYSGLNQRRIGSGEGRGSLLTCGDVEENP GPMRISKPHLRSISIQCYLCLLLNSHFLTEAGIHVFILGCF SAGLPKTEANWVNVISDLKKIEDLIQSMHIDATLYTESDVH PSCKVTAMKCFLLELQVISLESGDASIHDTVENLIILANNS LSSNGNVTESGCKECEELEEKNIKEFLQSFVHIVQMFINTS SGGGSGGGGSGGGGSGGGGSGGGSLQITCPPPMSVEHADIW VKSYSLYSRERYICNSGFKRKAGTSSLTECVLNKATNVAHW TTPSLKCIRDPALVHQRPAPPSTVTTAGVTPQPESLSPSGK EPAASSPSSNNTAATTAAIVPGSQLMPSKSPSTGTTEISSH ESSHGTPSQTTAKNWELTASASHQPPGVYPQGHSDTTVAIS TSTVLLCGLSAVSLLACYLKSRQTPPLASVEMEAMEALPVT WGTSSRDEDLENCSHHL |
| | 1234 | GM-CSFRa Signal Peptide | MLLLVTSLLLCELPHPAFLLIP |
| | 1012 | C10 vL | QSALTQPRSVSGSPGQSVTISCTGTSSDVGGYNYVSWYQQH PGKAPKLMIYDVTNRPSGVPDRFSASKSDNTATLTVSGVQA EDEADYYCSSYAGSHELFGGGTKLTVL |
| | 1237 | Linker | GSTSGSGKPGSGEGSTKG |
| | 800 | C10 vH | EVQLVQSGAEVKKPGESLKISCKGSGYSFTSYWIGWVRQMP GKGLEWMGIIYPGDSDTRYSPSFQGQVTISADKSISTAYLQ WSSLKASDTAMYYCAISRTESYVMDVWGQGTTVTVSS |
| | 692 | Linker | AAAGGGGSGGGGSGGGGSLE |
| | 1235 | CD3e | DGNEEMGGITQTPYKVSISGTTVILTCPQYPGSEILWQHND KNIGGDEDDKNIGSDEDHLSLKEFSELEQSGYYVCYPRGSK PEDANFYLYLRARVCENCMEMDVMSVATIVIVDICITGGLL LLVYYWSKNRKAKAKPVTRGAGAGGRQRGQNKERPPPVPNP DYEPIRKGQRDLYSGLNQRRI |

TABLE 12-continued

Table of Exemplary Construct Sequences

| Construct | SEQ ID NO: | Component | Sequence |
|---|---|---|---|
| | 1238 | T2A | GSGEGRGSLLTCGDVEENPGP |
| | 1241 | IL15-IL15Ra Fusion protein | MRISKPHLRSISIQCYLCLLLNSHFLTEAGIHVFILGCFSA GLPKTEANWVNVISDLKKIEDLIQSMHIDATLYTESDVHPS CKVTAMKCFLLELQVISLESGDASIHDTVENLIILANNSLS SNGNVTESGCKECEELEEKNIKEFLQSFVHIVQMFINTSSG GGSGGGGSGGGGSGGGGSGGGSLQITCPPPMSVEHADIWVK SYSLYSRERYICNSGFKRKAGTSSLTECVLNKATNVAHWTT PSLKCIRDPALVHQRPAPPSTVTTAGVTPQPESLSPSGKEP AASSPSSNNTAATTAAIVPGSQLMPSKSPSTGTTEISSHES SHGTPSQTTAKNWELTASASHQPPGVYPQGHSDTTVAISTS TVLLCGLSAVSLLACYLKSRQTPPLASVEMEAMEALPVTWG TSSRDEDLENCSHHL |

SEQUENCE LISTING (1324 sequences)

SEQ ID NO: 1 - protein, 26 aa, Artificial Sequence
  Description of Artificial Sequence: Synthetic peptide
QVQLQESGGGLVQTGGSLRLSCTASG

SEQ ID NO: 2 - protein, 26 aa, Artificial Sequence
  Description of Artificial Sequence: Synthetic peptide
QVQLQESGGGLVQTGGSLRLSCTASG

SEQ ID NO: 3 - protein, 26 aa, Artificial Sequence
  Description of Artificial Sequence: Synthetic peptide
QVQLQESGGGLVQTGGSLRLSCTASG

SEQ ID NO: 4 - protein, 26 aa, Artificial Sequence
  Description of Artificial Sequence: Synthetic peptide
QVQLQESGGGLVQTGGSLRLSCTASG

SEQ ID NO: 5 - protein, 26 aa, Artificial Sequence
  Description of Artificial Sequence: Synthetic peptide
QVQLQESGGGLVQTGGSLRLSCTASG

SEQ ID NO: 6 - protein, 26 aa, Artificial Sequence
  Description of Artificial Sequence: Synthetic peptide
QVQLQESGGGLVQPGGSLRLSCVASG

SEQ ID NO: 7 - protein, 26 aa, Artificial Sequence
  Description of Artificial Sequence: Synthetic peptide
QVQLQESGGGLVQPGGSLRLSCVASG

SEQ ID NO: 8 - protein, 26 aa, Artificial Sequence
  Description of Artificial Sequence: Synthetic peptide
QVQLQESGGGLVQPGGSLRLSCVASG

SEQ ID NO: 9 - protein, 26 aa, Artificial Sequence
  Description of Artificial Sequence: Synthetic peptide
QVQLQESGGGLVQPGGSLRLSCAASG

SEQ ID NO: 10 - protein, 26 aa, Artificial Sequence
  Description of Artificial Sequence: Synthetic peptide
QVQLQESGGGLVQPGGSLRLSCTASD

SEQ ID NO: 11 - protein, 26 aa, Artificial Sequence
  Description of Artificial Sequence: Synthetic peptide
QVQLQESGGGLVQAGGSLRLSCAAPG

SEQ ID NO: 12 - protein, 26 aa, Artificial Sequence
  Description of Artificial Sequence: Synthetic peptide
QVQLQESGGGLVQTGGSLRLSCAASG

SEQ ID NO: 13 - protein, 26 aa, Artificial Sequence
  Description of Artificial Sequence: Synthetic peptide
QVQLQESGGGLVQAGGSLRLSCAASK

SEQ ID NO: 14 - protein, 26 aa, Artificial Sequence
  Description of Artificial Sequence: Synthetic peptide
QVQLQESGGGLVQPGGSLRLSCAASK

SEQ ID NO: 15 - protein, 26 aa, Artificial Sequence
  Description of Artificial Sequence: Synthetic peptide
QVQLQESGGGLVQAGGSLRLSCAASK

SEQ ID NO: 16 - protein, 26 aa, Artificial Sequence
  Description of Artificial Sequence: Synthetic peptide
QVQLQESGGGLVQPGGSLRLSCVASG

SEQ ID NO: 17 - protein, 26 aa, Artificial Sequence
  Description of Artificial Sequence: Synthetic peptide
QVQLQESGGGLVQPGGSLRLSCAASG

SEQ ID NO: 18 - protein, 26 aa, Artificial Sequence
  Description of Artificial Sequence: Synthetic peptide
QVQLQESGGGLVQPGGSLRLSCTASG

SEQ ID NO: 19 - protein, 26 aa, Artificial Sequence
  Description of Artificial Sequence: Synthetic peptide
QIQLVQSGPEVKKPGETVKISCKASG

SEQ ID NO: 20 - protein, 26 aa, Artificial Sequence
  Description of Artificial Sequence: Synthetic peptide
EVQLVESGGGLVQPGGSLRLSCAASG

SEQ ID NO: 21 - protein, 26 aa, Artificial Sequence
  Description of Artificial Sequence: Synthetic peptide
QVQLQESGGGLVQPGGSLRLSCTASG

SEQ ID NO: 22 - protein, 26 aa, Artificial Sequence
  Description of Artificial Sequence: Synthetic peptide
QVQLQESGGGLVQPGGSLRLSCTASG

SEQ ID NO: 23 - protein, 26 aa, Artificial Sequence
  Description of Artificial Sequence: Synthetic peptide
QVQLQESGGGLVQPGGSLRLSCTASG

SEQ ID NO: 24 - protein, 26 aa, Artificial Sequence
  Description of Artificial Sequence: Synthetic peptide
QVQLQESGGGLVQPGGSLRLSCTASG

SEQ ID NO: 25 - protein, 26 aa, Artificial Sequence
  Description of Artificial Sequence: Synthetic peptide
QVQLQESGGGLVQPGGSLRLSCTASG

SEQ ID NO: 26 - protein, 26 aa, Artificial Sequence
  Description of Artificial Sequence: Synthetic peptide
QVQLQESGGGLVQPGGSLRLSCAASG

SEQ ID NO: 27 - protein, 26 aa, Artificial Sequence
  Description of Artificial Sequence: Synthetic peptide
QVQLQESGGGLVQTGGSLRLSCTASG

SEQ ID NO: 28 - protein, 26 aa, Artificial Sequence
  Description of Artificial Sequence: Synthetic peptide
QVQLQESGGGLVQTGGSLRLSCTASG

SEQ ID NO: 29 - protein, 26 aa, Artificial Sequence
  Description of Artificial Sequence: Synthetic peptide
QVQLQESGGGLVQTGGSLRLSCTASG

SEQ ID NO: 30 - protein, 26 aa, Artificial Sequence
  Description of Artificial Sequence: Synthetic peptide
QVQLQESGGGLVQTGGSLRLSCTASG

SEQ ID NO: 31 - protein, 26 aa, Artificial Sequence
  Description of Artificial Sequence: Synthetic peptide
QVQLQESGGGLVHAGGSLRLSCAVSG

SEQ ID NO: 32 - protein, 26 aa, Artificial Sequence
  Description of Artificial Sequence: Synthetic peptide
QVQLQESGGGLVQSEGSLRLSCAASG

SEQ ID NO: 33 - protein, 26 aa, Artificial Sequence
  Description of Artificial Sequence: Synthetic peptide
QVQLQESGGGLVQTGGSLRLSCTASG

SEQ ID NO: 34 - protein, 26 aa, Artificial Sequence
  Description of Artificial Sequence: Synthetic peptide
QVQLQESGGGLVQTGGSLRLSCTASG

SEQ ID NO: 35 - protein, 26 aa, Artificial Sequence
  Description of Artificial Sequence: Synthetic peptide
QVQLQESGGGLVQTGGSLRLSCTASG

SEQ ID NO: 36 - protein, 26 aa, Artificial Sequence
  Description of Artificial Sequence: Synthetic peptide
QVQLQESGGGLVQTGGSLRLSCTVSG

SEQ ID NO: 37 - protein, 26 aa, Artificial Sequence
  Description of Artificial Sequence: Synthetic peptide
QVQLQESGGGLVQTGGSLRLSCTASG

SEQ ID NO: 38 - protein, 26 aa, Artificial Sequence
  Description of Artificial Sequence: Synthetic peptide
QVQLQESGGGLVQTGGSLRLSCTASG

SEQ ID NO: 39 - protein, 26 aa, Artificial Sequence
  Description of Artificial Sequence: Synthetic peptide
QVQLQESGGGLVQTGGSLRLSCTASG

SEQ ID NO: 40 - protein, 26 aa, Artificial Sequence
  Description of Artificial Sequence: Synthetic peptide
QVQLQESGGGLVQAGGSLRLSCTASG

SEQ ID NO: 41 - protein, 26 aa, Artificial Sequence
  Description of Artificial Sequence: Synthetic peptide
QVQLQESGGGLVQPGGSLRLSCTASG

SEQ ID NO: 42 - protein, 26 aa, Artificial Sequence
  Description of Artificial Sequence: Synthetic peptide
QVQLQESGGGLVQPGGSLRLSCTASG

SEQ ID NO: 43 - protein, 26 aa, Artificial Sequence
  Description of Artificial Sequence: Synthetic peptide
QVQLQESGGGLVQPGGSLRLSCTASG

SEQ ID NO: 44 - protein, 26 aa, Artificial Sequence
  Description of Artificial Sequence: Synthetic peptide
QVQLQESGGGLVQPGGSLRLSCTASG

SEQ ID NO: 45 - protein, 26 aa, Artificial Sequence
  Description of Artificial Sequence: Synthetic peptide
QVQLQESGGGLAQPGGSLRLSCTASG

SEQ ID NO: 46 - protein, 26 aa, Artificial Sequence
  Description of Artificial Sequence: Synthetic peptide
QVQLQESGGGLVQSGGSLRLSCTASG

SEQ ID NO: 47 - protein, 26 aa, Artificial Sequence
  Description of Artificial Sequence: Synthetic peptide
QVQLQESGGGLVQPGGSLRLSCTASG

SEQ ID NO: 48 - protein, 26 aa, Artificial Sequence
  Description of Artificial Sequence: Synthetic peptide
QVQLQESGGGLVQTGGSLRLSCTASG

SEQ ID NO: 49 - protein, 26 aa, Artificial Sequence
  Description of Artificial Sequence: Synthetic peptide
QVQLQESGGGLVQTGGSLRLSCTASG

SEQ ID NO: 50 - protein, 26 aa, Artificial Sequence
  Description of Artificial Sequence: Synthetic peptide
QVQLQESGGGLVQTGGSLRLSCTASG

SEQ ID NO: 51 - protein, 26 aa, Artificial Sequence
  Description of Artificial Sequence: Synthetic peptide
QVQLQESGGGLVQTGGSLRLSCTASG

SEQ ID NO: 52 - protein, 26 aa, Artificial Sequence
  Description of Artificial Sequence: Synthetic peptide
QVQLQESGGGLVRTGGSLRLSCTASG

SEQ ID NO: 53 - protein, 26 aa, Artificial Sequence
  Description of Artificial Sequence: Synthetic peptide
QVQLQESGGGLVRPGGSLRLSCTASG

SEQ ID NO: 54 - protein, 26 aa, Artificial Sequence
  Description of Artificial Sequence: Synthetic peptide
QVQLQESGGGLVQPGGSLRLSCTASG

SEQ ID NO: 55 - protein, 26 aa, Artificial Sequence
  Description of Artificial Sequence: Synthetic peptide
QVQLQESGGGLVQPGESLRLSCTASG

SEQ ID NO: 56 - protein, 26 aa, Artificial Sequence
  Description of Artificial Sequence: Synthetic peptide
QVQLQESGGGLVQPGGSLRLSCTASG

SEQ ID NO: 57 - protein, 26 aa, Artificial Sequence
  Description of Artificial Sequence: Synthetic peptide
QVQLQESGGGLVQPGGSLRLSCTASG

SEQ ID NO: 58 - protein, 26 aa, Artificial Sequence
  Description of Artificial Sequence: Synthetic peptide
QVQLQESGGGSVQPGGSLRLSCTASG

SEQ ID NO: 59 - protein, 26 aa, Artificial Sequence
  Description of Artificial Sequence: Synthetic peptide
QVQLQESGGGLVQAGGSLRLSCTASG

SEQ ID NO: 60 - protein, 26 aa, Artificial Sequence
  Description of Artificial Sequence: Synthetic peptide
QVQLQESGGGSVQAGGSLRLSCTASG

SEQ ID NO: 61 - protein, 26 aa, Artificial Sequence
  Description of Artificial Sequence: Synthetic peptide
QVQLQESGGGSVQAGGSLRLSCTASG

SEQ ID NO: 62 - protein, 26 aa, Artificial Sequence
  Description of Artificial Sequence: Synthetic peptide
QVQLQESGGGSVQTGGSLRLSCTASG

SEQ ID NO: 63 - protein, 26 aa, Artificial Sequence
  Description of Artificial Sequence: Synthetic peptide
QVQLQESGGGLVHPGGSLRLSCTASG

SEQ ID NO: 64 - protein, 26 aa, Artificial Sequence
  Description of Artificial Sequence: Synthetic peptide
QVQLQESGGGLVQTGGSLRLSCTASG

SEQ ID NO: 65 - protein, 26 aa, Artificial Sequence
  Description of Artificial Sequence: Synthetic peptide
QVQLQESGGGLVRPGGSLRLSCTASG

SEQ ID NO: 66 - protein, 26 aa, Artificial Sequence
  Description of Artificial Sequence: Synthetic peptide
QVQLQESGGGLVQTGGPLRLSCTASG

SEQ ID NO: 67 - protein, 26 aa, Artificial Sequence
  Description of Artificial Sequence: Synthetic peptide
QVQLQESGGGLVQTGGSLRLSCTASG

SEQ ID NO: 68 - protein, 26 aa, Artificial Sequence
  Description of Artificial Sequence: Synthetic peptide
QVQLQESGGGLVQTGGSLRLSCTASG

SEQ ID NO: 69 - protein, 26 aa, Artificial Sequence
  Description of Artificial Sequence: Synthetic peptide
QVQLQESGGGLVQPGGSLRLSCTASG

SEQ ID NO: 70 - protein, 26 aa, Artificial Sequence
  Description of Artificial Sequence: Synthetic peptide
QVQLQESGGGLVQTGGSLRLSCTASG

SEQ ID NO: 71 - protein, 26 aa, Artificial Sequence
  Description of Artificial Sequence: Synthetic peptide
QVQLQESGGGLVEPGESLTLSCVASG

SEQ ID NO: 72 - protein, 26 aa, Artificial Sequence
  Description of Artificial Sequence: Synthetic peptide
QVQLQESGGGLVQPGGSLRLSCAASG

SEQ ID NO: 73 - protein, 26 aa, Artificial Sequence
  Description of Artificial Sequence: Synthetic peptide
QVQLQESGGGLVQPGGSLRLSCAASG

SEQ ID NO: 74 - protein, 26 aa, Artificial Sequence
  Description of Artificial Sequence: Synthetic peptide
QVQLQESGGGLVQPGGSLRLSCAASG

SEQ ID NO: 75 - protein, 26 aa, Artificial Sequence
  Description of Artificial Sequence: Synthetic peptide
QVQLQESGGGFVQPGGSLQLSCAVSG

SEQ ID NO: 76 - protein, 26 aa, Artificial Sequence
  Description of Artificial Sequence: Synthetic peptide
QVQLQESGGGLVQPGGSLRLSCAVSG

SEQ ID NO: 77 - protein, 26 aa, Artificial Sequence
  Description of Artificial Sequence: Synthetic peptide
QVQLQESGGGLVQPGGSLRLSCVAPG

SEQ ID NO: 78 - protein, 26 aa, Artificial Sequence
  Description of Artificial Sequence: Synthetic peptide
QVQLQESGGGLVQPGGSLRLSCVASG

SEQ ID NO: 79 - protein, 26 aa, Artificial Sequence
  Description of Artificial Sequence: Synthetic peptide
QVQLQESGGGLVQPGGSLRLSCGASD

SEQ ID NO: 80 - protein, 26 aa, Artificial Sequence
  Description of Artificial Sequence: Synthetic peptide
QVQLQESGGGLVQPGGSLRLSCTASD

SEQ ID NO: 81 - protein, 26 aa, Artificial Sequence
  Description of Artificial Sequence: Synthetic peptide
QVQLQESGGGLVQPGGSLRLSCVASG

SEQ ID NO: 82 - protein, 26 aa, Artificial Sequence
  Description of Artificial Sequence: Synthetic peptide
QVQLQESGGGLVQAGGSLRLSCAASG

SEQ ID NO: 83 - protein, 26 aa, Artificial Sequence
  Description of Artificial Sequence: Synthetic peptide
QVQLQESGGGLVQPGGSLRLSCAASG

SEQ ID NO: 84 - protein, 26 aa, Artificial Sequence
  Description of Artificial Sequence: Synthetic peptide
QVQLQESGGGLVQAGGSLRLSCAASG

SEQ ID NO: 85 - protein, 26 aa, Artificial Sequence
  Description of Artificial Sequence: Synthetic peptide
QVQLQESGGGLVQPGGSLRLSCTASK

SEQ ID NO: 86 - protein, 26 aa, Artificial Sequence
  Description of Artificial Sequence: Synthetic peptide
QVQLQESGGGLVQPGGSLRLSCTASG

SEQ ID NO: 87 - protein, 9 aa, Artificial Sequence
  Description of Artificial Sequence: Synthetic peptide
SIFDIARGN

SEQ ID NO: 88 - protein, 9 aa, Artificial Sequence
  Description of Artificial Sequence: Synthetic peptide
SIFDIARGN

SEQ ID NO: 89 - protein, 9 aa, Artificial Sequence
  Description of Artificial Sequence: Synthetic peptide
SIFDIVRGS

SEQ ID NO: 90 - protein, 9 aa, Artificial Sequence
  Description of Artificial Sequence: Synthetic peptide
STFDIARGN

SEQ ID NO: 91 - protein, 9 aa, Artificial Sequence
  Description of Artificial Sequence: Synthetic peptide
SIFDIARGN

SEQ ID NO: 92 - protein, 9 aa, Artificial Sequence
  Description of Artificial Sequence: Synthetic peptide
FTLDRYAVG

SEQ ID NO: 93 - protein, 9 aa, Artificial Sequence
  Description of Artificial Sequence: Synthetic peptide
FTLDRYSVN

SEQ ID NO: 94 - protein, 9 aa, Artificial Sequence
  Description of Artificial Sequence: Synthetic peptide
FTLDKYAIG

SEQ ID NO: 95 - protein, 9 aa, Artificial Sequence
  Description of Artificial Sequence: Synthetic peptide
FTLEHYSIG

SEQ ID NO: 96 - protein, 9 aa, Artificial Sequence
  Description of Artificial Sequence: Synthetic peptide
FNLERYAIN

SEQ ID NO: 97 - protein, 9 aa, Artificial Sequence
  Description of Artificial Sequence: Synthetic peptide
FTFDAYAIG

SEQ ID NO: 98 - protein, 9 aa, Artificial Sequence
  Description of Artificial Sequence: Synthetic peptide
HTFDAYAIG

SEQ ID NO: 99 - protein, 9 aa, Artificial Sequence
  Description of Artificial Sequence: Synthetic peptide
SIIRDNVMA

SEQ ID NO: 100 - protein, 9 aa, Artificial Sequence
  Description of Artificial Sequence: Synthetic peptide
SIIRDNVMA

SEQ ID NO: 101 - protein, 9 aa, Artificial Sequence
  Description of Artificial Sequence: Synthetic peptide
SIIRDNVMA

SEQ ID NO: 102 - protein, 9 aa, Artificial Sequence
  Description of Artificial Sequence: Synthetic peptide
SIFSIARMN

SEQ ID NO: 103 - protein, 9 aa, Artificial Sequence
  Description of Artificial Sequence: Synthetic peptide
FTLDYYAIA

SEQ ID NO: 104 - protein, 9 aa, Artificial Sequence
  Description of Artificial Sequence: Synthetic peptide
SIFSATRME

SEQ ID NO: 105 - protein, 9 aa, Artificial Sequence
  Description of Artificial Sequence: Synthetic peptide
YTFTNYGMN

SEQ ID NO: 106 - protein, 9 aa, Artificial Sequence
  Description of Artificial Sequence: Synthetic peptide
FTFSVYYMN

SEQ ID NO: 107 - protein, 9 aa, Artificial Sequence
  Description of Artificial Sequence: Synthetic peptide
SIFDIARGN

SEQ ID NO: 108 - protein, 9 aa, Artificial Sequence
  Description of Artificial Sequence: Synthetic peptide
SIFDIARGN

SEQ ID NO: 109 - protein, 9 aa, Artificial Sequence
  Description of Artificial Sequence: Synthetic peptide
SIFDIARGN

SEQ ID NO: 110 - protein, 9 aa, Artificial Sequence
  Description of Artificial Sequence: Synthetic peptide
SIFDIARGN

SEQ ID NO: 111 - protein, 9 aa, Artificial Sequence
  Description of Artificial Sequence: Synthetic peptide
SIFDIARGN

SEQ ID NO: 112 - protein, 9 aa, Artificial Sequence
  Description of Artificial Sequence: Synthetic peptide
SIFDIARGN

SEQ ID NO: 113 - protein, 9 aa, Artificial Sequence
  Description of Artificial Sequence: Synthetic peptide
SIFDIARGN

SEQ ID NO: 114 - protein, 9 aa, Artificial Sequence
  Description of Artificial Sequence: Synthetic peptide
SIFDIARGN

SEQ ID NO: 115 - protein, 9 aa, Artificial Sequence
  Description of Artificial Sequence: Synthetic peptide
SIFDIARGN

SEQ ID NO: 116 - protein, 9 aa, Artificial Sequence
  Description of Artificial Sequence: Synthetic peptide
SIFDIARGN

SEQ ID NO: 117 - protein, 9 aa, Artificial Sequence
  Description of Artificial Sequence: Synthetic peptide
SIFDIVRGS

SEQ ID NO: 118 - protein, 9 aa, Artificial Sequence
  Description of Artificial Sequence: Synthetic peptide
SIFDIVRGS

SEQ ID NO: 119 - protein, 9 aa, Artificial Sequence
  Description of Artificial Sequence: Synthetic peptide
SIFDIVRGS

SEQ ID NO: 120 - protein, 9 aa, Artificial Sequence
  Description of Artificial Sequence: Synthetic peptide
SIFDIVRGS

SEQ ID NO: 121 - protein, 9 aa, Artificial Sequence
  Description of Artificial Sequence: Synthetic peptide
SIFDIVRGS

SEQ ID NO: 122 - protein, 9 aa, Artificial Sequence
  Description of Artificial Sequence: Synthetic peptide
SIFDIVRGS

SEQ ID NO: 123 - protein, 9 aa, Artificial Sequence
  Description of Artificial Sequence: Synthetic peptide
SIFDIVRGS

SEQ ID NO: 124 - protein, 9 aa, Artificial Sequence
  Description of Artificial Sequence: Synthetic peptide
SIFDIVRGN

SEQ ID NO: 125 - protein, 9 aa, Artificial Sequence
  Description of Artificial Sequence: Synthetic peptide
SIFDIVRGN

SEQ ID NO: 126 - protein, 9 aa, Artificial Sequence
  Description of Artificial Sequence: Synthetic peptide
SIFDIVRGN

SEQ ID NO: 127 - protein, 9 aa, Artificial Sequence
  Description of Artificial Sequence: Synthetic peptide
SIFDIVRGN

SEQ ID NO: 128 - protein, 9 aa, Artificial Sequence
  Description of Artificial Sequence: Synthetic peptide
SIFDIVRGN

SEQ ID NO: 129 - protein, 9 aa, Artificial Sequence
  Description of Artificial Sequence: Synthetic peptide
SIFDIVRGN

SEQ ID NO: 130 - protein, 9 aa, Artificial Sequence
  Description of Artificial Sequence: Synthetic peptide
SIFGIVRGS

SEQ ID NO: 131 - protein, 9 aa, Artificial Sequence
  Description of Artificial Sequence: Synthetic peptide
SIFDIVRGS

SEQ ID NO: 132 - protein, 9 aa, Artificial Sequence
  Description of Artificial Sequence: Synthetic peptide
SIFDIVRGS

SEQ ID NO: 133 - protein, 9 aa, Artificial Sequence
  Description of Artificial Sequence: Synthetic peptide
SIFDIVRGS

SEQ ID NO: 134 - protein, 9 aa, Artificial Sequence
  Description of Artificial Sequence: Synthetic peptide
GIFDIARGN

SEQ ID NO: 135 - protein, 9 aa, Artificial Sequence
  Description of Artificial Sequence: Synthetic peptide
SIFGIARGN

SEQ ID NO: 136 - protein, 9 aa, Artificial Sequence
  Description of Artificial Sequence: Synthetic peptide
SIFDIARGN

SEQ ID NO: 137 - protein, 9 aa, Artificial Sequence
  Description of Artificial Sequence: Synthetic peptide
SIFDIARGN

SEQ ID NO: 138 - protein, 9 aa, Artificial Sequence
  Description of Artificial Sequence: Synthetic peptide
SIFDIARGN

SEQ ID NO: 139 - protein, 9 aa, Artificial Sequence
  Description of Artificial Sequence: Synthetic peptide
SIFDIARGN

SEQ ID NO: 140 - protein, 9 aa, Artificial Sequence
  Description of Artificial Sequence: Synthetic peptide
SIFDIARGN

SEQ ID NO: 141 - protein, 9 aa, Artificial Sequence
  Description of Artificial Sequence: Synthetic peptide
SIFDIARGN

SEQ ID NO: 142 - protein, 9 aa, Artificial Sequence
  Description of Artificial Sequence: Synthetic peptide
SIFDIARGN

SEQ ID NO: 143 - protein, 9 aa, Artificial Sequence
  Description of Artificial Sequence: Synthetic peptide
SIFDIARGN

SEQ ID NO: 144 - protein, 9 aa, Artificial Sequence
  Description of Artificial Sequence: Synthetic peptide
SIFDIARGN

SEQ ID NO: 145 - protein, 9 aa, Artificial Sequence
  Description of Artificial Sequence: Synthetic peptide
SIFDIARGN

SEQ ID NO: 146 - protein, 9 aa, Artificial Sequence
  Description of Artificial Sequence: Synthetic peptide
SIFDIARGN

SEQ ID NO: 147 - protein, 9 aa, Artificial Sequence
  Description of Artificial Sequence: Synthetic peptide
SIFDIARGN

SEQ ID NO: 148 - protein, 9 aa, Artificial Sequence
  Description of Artificial Sequence: Synthetic peptide
SIFDIARGN

SEQ ID NO: 149 - protein, 9 aa, Artificial Sequence
  Description of Artificial Sequence: Synthetic peptide
SIFDIVRGS

SEQ ID NO: 150 - protein, 9 aa, Artificial Sequence
  Description of Artificial Sequence: Synthetic peptide
SIFDIVRGS

SEQ ID NO: 151 - protein, 9 aa, Artificial Sequence
  Description of Artificial Sequence: Synthetic peptide
SIFDIVRGS

SEQ ID NO: 152 - protein, 9 aa, Artificial Sequence
  Description of Artificial Sequence: Synthetic peptide
SIFDIVRGS

SEQ ID NO: 153 - protein, 9 aa, Artificial Sequence
  Description of Artificial Sequence: Synthetic peptide
SIFDIVRGS

SEQ ID NO: 154 - protein, 9 aa, Artificial Sequence
  Description of Artificial Sequence: Synthetic peptide
SIFDIVRGS

SEQ ID NO: 155 - protein, 9 aa, Artificial Sequence
  Description of Artificial Sequence: Synthetic peptide
SIFDIVRGS

SEQ ID NO: 156 - protein, 9 aa, Artificial Sequence
  Description of Artificial Sequence: Synthetic peptide
SIFDIVRGS

SEQ ID NO: 157 - protein, 9 aa, Artificial Sequence
  Description of Artificial Sequence: Synthetic peptide
LSFDRYAIG

SEQ ID NO: 158 - protein, 9 aa, Artificial Sequence
  Description of Artificial Sequence: Synthetic peptide
FTLERYAVG

SEQ ID NO: 159 - protein, 9 aa, Artificial Sequence
  Description of Artificial Sequence: Synthetic peptide
FTLEHYSIG

SEQ ID NO: 160 - protein, 9 aa, Artificial Sequence
  Description of Artificial Sequence: Synthetic peptide
FTLEHYSMG

SEQ ID NO: 161 - protein, 9 aa, Artificial Sequence
  Description of Artificial Sequence: Synthetic peptide
RSRDYYSIN

SEQ ID NO: 162 - protein, 9 aa, Artificial Sequence
  Description of Artificial Sequence: Synthetic peptide
FTLEHYTIG

SEQ ID NO: 163 - protein, 9 aa, Artificial Sequence
  Description of Artificial Sequence: Synthetic peptide
FTLDKYAIG

SEQ ID NO: 164 - protein, 9 aa, Artificial Sequence
  Description of Artificial Sequence: Synthetic peptide
FTLDKYAIG

SEQ ID NO: 165 - protein, 9 aa, Artificial Sequence
  Description of Artificial Sequence: Synthetic peptide
FTLENYAIG

SEQ ID NO: 166 - protein, 9 aa, Artificial Sequence
  Description of Artificial Sequence: Synthetic peptide
FNLERYAIN

SEQ ID NO: 167 - protein, 9 aa, Artificial Sequence
  Description of Artificial Sequence: Synthetic peptide
FTLDYYAIN

SEQ ID NO: 168 - protein, 9 aa, Artificial Sequence
  Description of Artificial Sequence: Synthetic peptide
FTFDAYAIG

SEQ ID NO: 169 - protein, 9 aa, Artificial Sequence
  Description of Artificial Sequence: Synthetic peptide
FTFDAYAIG

SEQ ID NO: 170 - protein, 9 aa, Artificial Sequence
  Description of Artificial Sequence: Synthetic peptide
SIIRDNVMA

SEQ ID NO: 171 - protein, 9 aa, Artificial Sequence
  Description of Artificial Sequence: Synthetic peptide
SIIRDNVMA

SEQ ID NO: 172 - protein, 9 aa, Artificial Sequence
  Description of Artificial Sequence: Synthetic peptide
SIFSATRME

SEQ ID NO: 173 - protein, 13 aa, Artificial Sequence
  Description of Artificial Sequence: Synthetic peptide
WYRQAPGKQRELV

SEQ ID NO: 174 - protein, 13 aa, Artificial Sequence
  Description of Artificial Sequence: Synthetic peptide
WYRQAPGKQRELV

SEQ ID NO: 175 - protein, 13 aa, Artificial Sequence
  Description of Artificial Sequence: Synthetic peptide
WYRQAPGNQRELV

SEQ ID NO: 176 - protein, 13 aa, Artificial Sequence
  Description of Artificial Sequence: Synthetic peptide
WYRQAPGKQRELV

SEQ ID NO: 177 - protein, 13 aa, Artificial Sequence
  Description of Artificial Sequence: Synthetic peptide
WYRQAPGKQRELV

SEQ ID NO: 178 - protein, 13 aa, Artificial Sequence
  Description of Artificial Sequence: Synthetic peptide
WFRQAPGKELEGV

SEQ ID NO: 179 - protein, 13 aa, Artificial Sequence
  Description of Artificial Sequence: Synthetic peptide
WFRQAPGKEREGV

SEQ ID NO: 180 - protein, 13 aa, Artificial Sequence
  Description of Artificial Sequence: Synthetic peptide
WFRQAPGKELEGV

SEQ ID NO: 181 - protein, 13 aa, Artificial Sequence
  Description of Artificial Sequence: Synthetic peptide
WFRQAPGKDLEGV

SEQ ID NO: 182 - protein, 13 aa, Artificial Sequence
  Description of Artificial Sequence: Synthetic peptide
WFRQAPGKEREGV

SEQ ID NO: 183 - protein, 13 aa, Artificial Sequence
  Description of Artificial Sequence: Synthetic peptide
WFRQAPGKEREGV

SEQ ID NO: 184 - protein, 13 aa, Artificial Sequence
  Description of Artificial Sequence: Synthetic peptide
WFRQAPGKEREGV

SEQ ID NO: 185 - protein, 13 aa, Artificial Sequence
  Description of Artificial Sequence: Synthetic peptide
WHRQAPGKQRELV

SEQ ID NO: 186 - protein, 13 aa, Artificial Sequence
  Description of Artificial Sequence: Synthetic peptide
WHRQAPGKQRELV

SEQ ID NO: 187 - protein, 13 aa, Artificial Sequence
  Description of Artificial Sequence: Synthetic peptide
WHRQAPGKQRELV

SEQ ID NO: 188 - protein, 13 aa, Artificial Sequence
  Description of Artificial Sequence: Synthetic peptide
WYRQAPGKQRELV

SEQ ID NO: 189 - protein, 13 aa, Artificial Sequence
  Description of Artificial Sequence: Synthetic peptide
WFRQAPGKQRELV

SEQ ID NO: 190 - protein, 13 aa, Artificial Sequence
  Description of Artificial Sequence: Synthetic peptide
WYRQAPGKQRELV

SEQ ID NO: 191 - protein, 13 aa, Artificial Sequence
  Description of Artificial Sequence: Synthetic peptide
WVKQAPGKGLKWM

SEQ ID NO: 192 - protein, 13 aa, Artificial Sequence
  Description of Artificial Sequence: Synthetic peptide
WVRQAPGKGLEWV

SEQ ID NO: 193 - protein, 13 aa, Artificial Sequence
  Description of Artificial Sequence: Synthetic peptide
WYRQAPGKQRELV

SEQ ID NO: 194 - protein, 13 aa, Artificial Sequence
  Description of Artificial Sequence: Synthetic peptide
WYRQAPGKQRELV

SEQ ID NO: 195 - protein, 13 aa, Artificial Sequence
  Description of Artificial Sequence: Synthetic peptide
WYRQAPGKQRELV

SEQ ID NO: 196 - protein, 13 aa, Artificial Sequence
  Description of Artificial Sequence: Synthetic peptide
WYRQAPGKQRELV

SEQ ID NO: 197 - protein, 13 aa, Artificial Sequence
  Description of Artificial Sequence: Synthetic peptide
WYRQAPGKQRELV

SEQ ID NO: 198 - protein, 13 aa, Artificial Sequence
  Description of Artificial Sequence: Synthetic peptide
WYRQAPGKQRELV

SEQ ID NO: 199 - protein, 13 aa, Artificial Sequence
  Description of Artificial Sequence: Synthetic peptide
WYRQAPGKQRELV

SEQ ID NO: 200 - protein, 13 aa, Artificial Sequence
  Description of Artificial Sequence: Synthetic peptide
WYRQAPGKQRELV

SEQ ID NO: 201 - protein, 13 aa, Artificial Sequence
  Description of Artificial Sequence: Synthetic peptide
WYRQAPGKQRELV

SEQ ID NO: 202 - protein, 13 aa, Artificial Sequence
  Description of Artificial Sequence: Synthetic peptide
WYRQAPGKQRELV

SEQ ID NO: 203 - protein, 13 aa, Artificial Sequence
  Description of Artificial Sequence: Synthetic peptide
WYRQAPGNQRELV

SEQ ID NO: 204 - protein, 13 aa, Artificial Sequence
  Description of Artificial Sequence: Synthetic peptide
WYRQAPGNQRELV

SEQ ID NO: 205 - protein, 13 aa, Artificial Sequence
  Description of Artificial Sequence: Synthetic peptide
WYRQAPGNQRELV

SEQ ID NO: 206 - protein, 13 aa, Artificial Sequence
  Description of Artificial Sequence: Synthetic peptide
WYRQAPGNQRELV

SEQ ID NO: 207 - protein, 13 aa, Artificial Sequence
  Description of Artificial Sequence: Synthetic peptide
WYRQVPGNQRELV

SEQ ID NO: 208 - protein, 13 aa, Artificial Sequence
  Description of Artificial Sequence: Synthetic peptide
WYRQAPGNQRELV

SEQ ID NO: 209 - protein, 13 aa, Artificial Sequence
  Description of Artificial Sequence: Synthetic peptide
WYRQAPGNQRELV

SEQ ID NO: 210 - protein, 13 aa, Artificial Sequence
  Description of Artificial Sequence: Synthetic peptide
WYRQAPGNQRELV

SEQ ID NO: 211 - protein, 13 aa, Artificial Sequence
  Description of Artificial Sequence: Synthetic peptide
WYRQAPGNQRELV

SEQ ID NO: 212 - protein, 13 aa, Artificial Sequence
  Description of Artificial Sequence: Synthetic peptide
WYRQAPGNQRELV

SEQ ID NO: 213 - protein, 13 aa, Artificial Sequence
  Description of Artificial Sequence: Synthetic peptide
WYRQAPGNQRELV

SEQ ID NO: 214 - protein, 13 aa, Artificial Sequence
  Description of Artificial Sequence: Synthetic peptide
WYRQAPGNQRELV

SEQ ID NO: 215 - protein, 13 aa, Artificial Sequence
  Description of Artificial Sequence: Synthetic peptide
WYRQAPGNQRELV

SEQ ID NO: 216 - protein, 13 aa, Artificial Sequence
  Description of Artificial Sequence: Synthetic peptide
WYRQAPGNQRELV

SEQ ID NO: 217 - protein, 13 aa, Artificial Sequence
  Description of Artificial Sequence: Synthetic peptide
WYRQAPGNQRELV

SEQ ID NO: 218 - protein, 13 aa, Artificial Sequence
  Description of Artificial Sequence: Synthetic peptide
WYRQAPGNQRELV

SEQ ID NO: 219 - protein, 13 aa, Artificial Sequence
  Description of Artificial Sequence: Synthetic peptide
WYRQAPGNQRELV

SEQ ID NO: 220 - protein, 13 aa, Artificial Sequence
  Description of Artificial Sequence: Synthetic peptide
WYRQAPGKQRELV

SEQ ID NO: 221 - protein, 13 aa, Artificial Sequence
  Description of Artificial Sequence: Synthetic peptide
WYRQAPGKQRELV

SEQ ID NO: 222 - protein, 13 aa, Artificial Sequence
  Description of Artificial Sequence: Synthetic peptide
WYRQAPGKQRELV

SEQ ID NO: 223 - protein, 13 aa, Artificial Sequence
  Description of Artificial Sequence: Synthetic peptide
WYRQAPGKQRELV

SEQ ID NO: 224 - protein, 13 aa, Artificial Sequence
  Description of Artificial Sequence: Synthetic peptide
WYRQAPGKQRELV

SEQ ID NO: 225 - protein, 13 aa, Artificial Sequence
  Description of Artificial Sequence: Synthetic peptide
WYRQAPGKQRELV

SEQ ID NO: 226 - protein, 13 aa, Artificial Sequence
  Description of Artificial Sequence: Synthetic peptide
WYRQAPGKQRELV

SEQ ID NO: 227 - protein, 13 aa, Artificial Sequence
  Description of Artificial Sequence: Synthetic peptide
WYRQAPGKQRELV

SEQ ID NO: 228 - protein, 13 aa, Artificial Sequence
  Description of Artificial Sequence: Synthetic peptide
WYRQAPGKQRELV

SEQ ID NO: 229 - protein, 13 aa, Artificial Sequence
  Description of Artificial Sequence: Synthetic peptide
WYRQAPGKQRELV

SEQ ID NO: 230 - protein, 13 aa, Artificial Sequence
  Description of Artificial Sequence: Synthetic peptide
WYRQAPGKQRELV

SEQ ID NO: 231 - protein, 13 aa, Artificial Sequence
  Description of Artificial Sequence: Synthetic peptide
WYRQAPGKQRELV

SEQ ID NO: 232 - protein, 13 aa, Artificial Sequence
  Description of Artificial Sequence: Synthetic peptide
WYRQAPGKQRELV

SEQ ID NO: 233 - protein, 13 aa, Artificial Sequence
  Description of Artificial Sequence: Synthetic peptide
WYRQAPGKQRELV

SEQ ID NO: 234 - protein, 13 aa, Artificial Sequence
  Description of Artificial Sequence: Synthetic peptide
WYRQAPGKQRELV

SEQ ID NO: 235 - protein, 13 aa, Artificial Sequence
  Description of Artificial Sequence: Synthetic peptide
WYRQAPGKQRELV

SEQ ID NO: 236 - protein, 13 aa, Artificial Sequence
  Description of Artificial Sequence: Synthetic peptide
WYRQAPGKQRELV

SEQ ID NO: 237 - protein, 13 aa, Artificial Sequence
  Description of Artificial Sequence: Synthetic peptide
WYRQAPGKQRELV

SEQ ID NO: 238 - protein, 13 aa, Artificial Sequence
  Description of Artificial Sequence: Synthetic peptide
WYRQAPGKQRELV

SEQ ID NO: 239 - protein, 13 aa, Artificial Sequence
  Description of Artificial Sequence: Synthetic peptide
WYRQAPGKQRELV

SEQ ID NO: 240 - protein, 13 aa, Artificial Sequence
  Description of Artificial Sequence: Synthetic peptide
WYRQAPGKQRELV

SEQ ID NO: 241 - protein, 13 aa, Artificial Sequence
  Description of Artificial Sequence: Synthetic peptide
WYRQAPGKQRELV

SEQ ID NO: 242 - protein, 13 aa, Artificial Sequence
  Description of Artificial Sequence: Synthetic peptide
WYRQAPGKQRELV

SEQ ID NO: 243 - protein, 13 aa, Artificial Sequence
  Description of Artificial Sequence: Synthetic peptide
WFRQAPGKEREGV

SEQ ID NO: 244 - protein, 13 aa, Artificial Sequence
  Description of Artificial Sequence: Synthetic peptide
WFRQAPGKEREGV

SEQ ID NO: 245 - protein, 13 aa, Artificial Sequence
  Description of Artificial Sequence: Synthetic peptide
WFRQAPGKDLEGV

SEQ ID NO: 246 - protein, 13 aa, Artificial Sequence
  Description of Artificial Sequence: Synthetic peptide
WFRQAPGKDLEGV

SEQ ID NO: 247 - protein, 13 aa, Artificial Sequence
  Description of Artificial Sequence: Synthetic peptide
WFRQAPGKEREGV

SEQ ID NO: 248 - protein, 13 aa, Artificial Sequence
  Description of Artificial Sequence: Synthetic peptide
WFRQAPGKELEGV

SEQ ID NO: 249 - protein, 13 aa, Artificial Sequence
  Description of Artificial Sequence: Synthetic peptide
WFRQAPGKELEGV

SEQ ID NO: 250 - protein, 13 aa, Artificial Sequence
  Description of Artificial Sequence: Synthetic peptide
WFRQAPGKELEGV

SEQ ID NO: 251 - protein, 13 aa, Artificial Sequence
  Description of Artificial Sequence: Synthetic peptide
WFRQAPGKEREGV

SEQ ID NO: 252 - protein, 13 aa, Artificial Sequence
  Description of Artificial Sequence: Synthetic peptide
WFRQAPGKEREGV

SEQ ID NO: 253 - protein, 13 aa, Artificial Sequence
  Description of Artificial Sequence: Synthetic peptide
WFRQAPGKEREGV

SEQ ID NO: 254 - protein, 13 aa, Artificial Sequence
  Description of Artificial Sequence: Synthetic peptide
WFRQAPGKEREGV

SEQ ID NO: 255 - protein, 13 aa, Artificial Sequence
  Description of Artificial Sequence: Synthetic peptide
WFRQAPGKEREGV

SEQ ID NO: 256 - protein, 13 aa, Artificial Sequence
  Description of Artificial Sequence: Synthetic peptide
WHRQAPGKQRELV

SEQ ID NO: 257 - protein, 13 aa, Artificial Sequence
  Description of Artificial Sequence: Synthetic peptide
WHRQAPGKQRELV

SEQ ID NO: 258 - protein, 13 aa, Artificial Sequence
  Description of Artificial Sequence: Synthetic peptide
WYRQAPGKQRELV

SEQ ID NO: 259 - protein, 12 aa, Artificial Sequence
  Description of Artificial Sequence: Synthetic peptide
AIITSGGATNYA

SEQ ID NO: 260 - protein, 12 aa, Artificial Sequence
  Description of Artificial Sequence: Synthetic peptide
AIITSGGATNYA

SEQ ID NO: 261 - protein, 12 aa, Artificial Sequence
  Description of Artificial Sequence: Synthetic peptide
AIITSGGATNYA

SEQ ID NO: 262 - protein, 12 aa, Artificial Sequence
  Description of Artificial Sequence: Synthetic peptide
AIITSGGATNYA

SEQ ID NO: 263 - protein, 12 aa, Artificial Sequence
  Description of Artificial Sequence: Synthetic peptide
AIITSGGATNYA

SEQ ID NO: 264 - protein, 13 aa, Artificial Sequence
  Description of Artificial Sequence: Synthetic peptide
SCISSSGDIIKYA

SEQ ID NO: 265 - protein, 13 aa, Artificial Sequence
  Description of Artificial Sequence: Synthetic peptide
TCITSSGDIIKYA

SEQ ID NO: 266 - protein, 13 aa, Artificial Sequence
  Description of Artificial Sequence: Synthetic peptide
SCITSSSGVVKYA

SEQ ID NO: 267 - protein, 13 aa, Artificial Sequence
  Description of Artificial Sequence: Synthetic peptide
SCITSSGGIPKYA

SEQ ID NO: 268 - protein, 13 aa, Artificial Sequence
  Description of Artificial Sequence: Synthetic peptide
LCITSSGGITKYA

SEQ ID NO: 269 - protein, 13 aa, Artificial Sequence
  Description of Artificial Sequence: Synthetic peptide
ICLSPSDGSTYYA

SEQ ID NO: 270 - protein, 13 aa, Artificial Sequence
  Description of Artificial Sequence: Synthetic peptide
ICLSPSDGSTYYA

SEQ ID NO: 271 - protein, 12 aa, Artificial Sequence
  Description of Artificial Sequence: Synthetic peptide
AIINTGGSANVD

SEQ ID NO: 272 - protein, 12 aa, Artificial Sequence
  Description of Artificial Sequence: Synthetic peptide
AIINTGGSANVD

SEQ ID NO: 273 - protein, 12 aa, Artificial Sequence
  Description of Artificial Sequence: Synthetic peptide
AIINTGGSANVD

SEQ ID NO: 274 - protein, 12 aa, Artificial Sequence
  Description of Artificial Sequence: Synthetic peptide
AILNRAGRTDYA

SEQ ID NO: 275 - protein, 12 aa, Artificial Sequence
  Description of Artificial Sequence: Synthetic peptide
AILNRAGRTDYA

SEQ ID NO: 276 - protein, 12 aa, Artificial Sequence
  Description of Artificial Sequence: Synthetic peptide
AIVTSGGRTNYA

SEQ ID NO: 277 - protein, 13 aa, Artificial Sequence
  Description of Artificial Sequence: Synthetic peptide
GWINTYTGEPTYA

SEQ ID NO: 278 - protein, 13 aa, Artificial Sequence
  Description of Artificial Sequence: Synthetic peptide
SDINNEGGTTYYA

SEQ ID NO: 279 - protein, 12 aa, Artificial Sequence
  Description of Artificial Sequence: Synthetic peptide
AIITSGGATNYA

SEQ ID NO: 280 - protein, 12 aa, Artificial Sequence
  Description of Artificial Sequence: Synthetic peptide
AIITSGDATNYA

SEQ ID NO: 281 - protein, 12 aa, Artificial Sequence
  Description of Artificial Sequence: Synthetic peptide
AIITSGDATNYA

SEQ ID NO: 282 - protein, 12 aa, Artificial Sequence
  Description of Artificial Sequence: Synthetic peptide
AIITSGDATNYA

SEQ ID NO: 283 - protein, 12 aa, Artificial Sequence
  Description of Artificial Sequence: Synthetic peptide
AIITSGGATDYA

SEQ ID NO: 284 - protein, 12 aa, Artificial Sequence
  Description of Artificial Sequence: Synthetic peptide
AIITSGGATNYA

SEQ ID NO: 285 - protein, 12 aa, Artificial Sequence
  Description of Artificial Sequence: Synthetic peptide
AIITSGGATNYA

SEQ ID NO: 286 - protein, 12 aa, Artificial Sequence
  Description of Artificial Sequence: Synthetic peptide
AIITSGGATNYA

SEQ ID NO: 287 - protein, 12 aa, Artificial Sequence
  Description of Artificial Sequence: Synthetic peptide
AIITSGGATNYA

SEQ ID NO: 288 - protein, 12 aa, Artificial Sequence
  Description of Artificial Sequence: Synthetic peptide
AIITSGGATNYA

SEQ ID NO: 289 - protein, 12 aa, Artificial Sequence
  Description of Artificial Sequence: Synthetic peptide
AIITSGGATNYA

SEQ ID NO: 290 - protein, 12 aa, Artificial Sequence
  Description of Artificial Sequence: Synthetic peptide
AIITSGGATNYA

SEQ ID NO: 291 - protein, 12 aa, Artificial Sequence
  Description of Artificial Sequence: Synthetic peptide
AIITSGGATNYA

SEQ ID NO: 292 - protein, 12 aa, Artificial Sequence
  Description of Artificial Sequence: Synthetic peptide
AIITSGGATNYA

SEQ ID NO: 293 - protein, 12 aa, Artificial Sequence
  Description of Artificial Sequence: Synthetic peptide
AIITSGGATNYA

SEQ ID NO: 294 - protein, 12 aa, Artificial Sequence
  Description of Artificial Sequence: Synthetic peptide
AIITSGGATNYA

SEQ ID NO: 295 - protein, 12 aa, Artificial Sequence
  Description of Artificial Sequence: Synthetic peptide
AIITSGGATNYA

SEQ ID NO: 296 - protein, 12 aa, Artificial Sequence
  Description of Artificial Sequence: Synthetic peptide
AIITSGGATNYA

SEQ ID NO: 297 - protein, 12 aa, Artificial Sequence
  Description of Artificial Sequence: Synthetic peptide
AIITSGGATNYA

SEQ ID NO: 298 - protein, 12 aa, Artificial Sequence
  Description of Artificial Sequence: Synthetic peptide
AIITSGGATNYA

SEQ ID NO: 299 - protein, 12 aa, Artificial Sequence
  Description of Artificial Sequence: Synthetic peptide
AIITSGGATNYA

SEQ ID NO: 300 - protein, 12 aa, Artificial Sequence
  Description of Artificial Sequence: Synthetic peptide
AIITSGGATNYA

SEQ ID NO: 301 - protein, 12 aa, Artificial Sequence
  Description of Artificial Sequence: Synthetic peptide
AIITSGGATNYA

SEQ ID NO: 302 - protein, 12 aa, Artificial Sequence
  Description of Artificial Sequence: Synthetic peptide
AIITSGGATNYA

SEQ ID NO: 303 - protein, 12 aa, Artificial Sequence
  Description of Artificial Sequence: Synthetic peptide
AIITSGGATNYA

SEQ ID NO: 304 - protein, 12 aa, Artificial Sequence
  Description of Artificial Sequence: Synthetic peptide
AIITSGGATNYA

SEQ ID NO: 305 - protein, 12 aa, Artificial Sequence
  Description of Artificial Sequence: Synthetic peptide
AIITSGGATNYA

SEQ ID NO: 306 - protein, 12 aa, Artificial Sequence
  Description of Artificial Sequence: Synthetic peptide
AIITSGGATNYA

SEQ ID NO: 307 - protein, 12 aa, Artificial Sequence
  Description of Artificial Sequence: Synthetic peptide
AIITSGGATNYA

SEQ ID NO: 308 - protein, 12 aa, Artificial Sequence
  Description of Artificial Sequence: Synthetic peptide
AIVTSGGATNYA

SEQ ID NO: 309 - protein, 12 aa, Artificial Sequence
  Description of Artificial Sequence: Synthetic peptide
AIITSGGATNYA

SEQ ID NO: 310 - protein, 12 aa, Artificial Sequence
  Description of Artificial Sequence: Synthetic peptide
AIITSGGATNYA

SEQ ID NO: 311 - protein, 12 aa, Artificial Sequence
  Description of Artificial Sequence: Synthetic peptide
AIITSGGATNYA

SEQ ID NO: 312 - protein, 12 aa, Artificial Sequence
  Description of Artificial Sequence: Synthetic peptide
AIVTSGGATNYA

SEQ ID NO: 313 - protein, 12 aa, Artificial Sequence
  Description of Artificial Sequence: Synthetic peptide
AIITSGGATNYA

SEQ ID NO: 314 - protein, 12 aa, Artificial Sequence
  Description of Artificial Sequence: Synthetic peptide
AIITSGGATNYA

SEQ ID NO: 315 - protein, 12 aa, Artificial Sequence
  Description of Artificial Sequence: Synthetic peptide
AIITSGGATNYA

SEQ ID NO: 316 - protein, 12 aa, Artificial Sequence
  Description of Artificial Sequence: Synthetic peptide
AIITSGGATNYA

SEQ ID NO: 317 - protein, 12 aa, Artificial Sequence
  Description of Artificial Sequence: Synthetic peptide
AIITSGGATNYA

SEQ ID NO: 318 - protein, 12 aa, Artificial Sequence
  Description of Artificial Sequence: Synthetic peptide
AIVTSGGATNYA

SEQ ID NO: 319 - protein, 12 aa, Artificial Sequence
  Description of Artificial Sequence: Synthetic peptide
AIITSGGATNYA

SEQ ID NO: 320 - protein, 12 aa, Artificial Sequence
  Description of Artificial Sequence: Synthetic peptide
AIITSGGATNYA

SEQ ID NO: 321 - protein, 12 aa, Artificial Sequence
  Description of Artificial Sequence: Synthetic peptide
AIITSGGATNYA

SEQ ID NO: 322 - protein, 12 aa, Artificial Sequence
  Description of Artificial Sequence: Synthetic peptide
AIITSGGATNYA

SEQ ID NO: 323 - protein, 12 aa, Artificial Sequence
  Description of Artificial Sequence: Synthetic peptide
AIITSGGATNYA

SEQ ID NO: 324 - protein, 12 aa, Artificial Sequence
  Description of Artificial Sequence: Synthetic peptide
AIITSGGATNYA

SEQ ID NO: 325 - protein, 12 aa, Artificial Sequence
  Description of Artificial Sequence: Synthetic peptide
AIITSGGATNYA

SEQ ID NO: 326 - protein, 12 aa, Artificial Sequence
  Description of Artificial Sequence: Synthetic peptide
AIITSGGATNYA

SEQ ID NO: 327 - protein, 12 aa, Artificial Sequence
  Description of Artificial Sequence: Synthetic peptide
AIITSGGATNYA

SEQ ID NO: 328 - protein, 12 aa, Artificial Sequence
  Description of Artificial Sequence: Synthetic peptide
AIITSGGATNYA

SEQ ID NO: 329 - protein, 13 aa, Artificial Sequence
  Description of Artificial Sequence: Synthetic peptide
ACISSKGGLTKYA

SEQ ID NO: 330 - protein, 13 aa, Artificial Sequence
  Description of Artificial Sequence: Synthetic peptide
SCVSSSGDITKYA

SEQ ID NO: 331 - protein, 13 aa, Artificial Sequence
  Description of Artificial Sequence: Synthetic peptide
SCITSSGGIPKYA

SEQ ID NO: 332 - protein, 13 aa, Artificial Sequence
  Description of Artificial Sequence: Synthetic peptide
SCITSSGGIPKYA

SEQ ID NO: 333 - protein, 13 aa, Artificial Sequence
  Description of Artificial Sequence: Synthetic peptide
SCISSSGGITKYA

SEQ ID NO: 334 - protein, 13 aa, Artificial Sequence
  Description of Artificial Sequence: Synthetic peptide
SCITSSGGVVKYA

SEQ ID NO: 335 - protein, 13 aa, Artificial Sequence
  Description of Artificial Sequence: Synthetic peptide
SCITSSSGVVKYA

SEQ ID NO: 336 - protein, 13 aa, Artificial Sequence
  Description of Artificial Sequence: Synthetic peptide
SCITSSGGVVKYA

SEQ ID NO: 337 - protein, 13 aa, Artificial Sequence
  Description of Artificial Sequence: Synthetic peptide
SCITSSGGITKYA

SEQ ID NO: 338 - protein, 13 aa, Artificial Sequence
  Description of Artificial Sequence: Synthetic peptide
LCITSSGGITKYA

SEQ ID NO: 339 - protein, 13 aa, Artificial Sequence
  Description of Artificial Sequence: Synthetic peptide
LCITSNGGITKYA

SEQ ID NO: 340 - protein, 13 aa, Artificial Sequence
  Description of Artificial Sequence: Synthetic peptide
ICLSPSDGSTYYA

SEQ ID NO: 341 - protein, 13 aa, Artificial Sequence
  Description of Artificial Sequence: Synthetic peptide
ICLSPSDGSTYYA

SEQ ID NO: 342 - protein, 12 aa, Artificial Sequence
  Description of Artificial Sequence: Synthetic peptide
AIINIGGSGNVD

SEQ ID NO: 343 - protein, 12 aa, Artificial Sequence
  Description of Artificial Sequence: Synthetic peptide
AIINTGGSANVD

SEQ ID NO: 344 - protein, 12 aa, Artificial Sequence
  Description of Artificial Sequence: Synthetic peptide
AIVTSGGRTNYA

SEQ ID NO: 345 - protein, 34 aa, Artificial Sequence
  Description of Artificial Sequence: Synthetic polypeptide
DSVAGRFTISRDDAKNTVYLQMNGLKPEDTAVYF

SEQ ID NO: 346 - protein, 34 aa, Artificial Sequence
  Description of Artificial Sequence: Synthetic polypeptide
DSVAGRFTISRDTAWKALYLQMNSLKPEDTAVYF

SEQ ID NO: 347 - protein, 34 aa, Artificial Sequence
  Description of Artificial Sequence: Synthetic polypeptide
DSVAGRFTISRDSAWKALYLQMNSLKPEDTAVYF

SEQ ID NO: 348 - protein, 34 aa, Artificial Sequence; identical to SEQ ID NO: 346
  Description of Artificial Sequence: Synthetic polypeptide

SEQ ID NO: 349 - protein, 34 aa, Artificial Sequence; identical to SEQ ID NO: 347
  Description of Artificial Sequence: Synthetic polypeptide

SEQ ID NO: 350 - protein, 34 aa, Artificial Sequence
  Description of Artificial Sequence: Synthetic polypeptide
DSAKGRFTIARDNAKNTAYLQMNSLKPEDTAVYY

SEQ ID NO: 351 - protein, 34 aa, Artificial Sequence
  Description of Artificial Sequence: Synthetic polypeptide
DSAKGRFTISRDNAKNTAYLEMNSLKPEDTAVYY

SEQ ID NO: 352 - protein, 34 aa, Artificial Sequence
  Description of Artificial Sequence: Synthetic polypeptide
DSVKGRFIISRDNTNNRAFLQMSSLKPEDTAVYY

SEQ ID NO: 353 - protein, 34 aa, Artificial Sequence
  Description of Artificial Sequence: Synthetic polypeptide
DSVKGRFIISRDNAKNTGYLQMNSLKPEDTAVYY

SEQ ID NO: 354 - protein, 34 aa, Artificial Sequence
  Description of Artificial Sequence: Synthetic polypeptide
NSVKGRFIISRDNTKNRAYLQMNSLKPEDTAVYY

SEQ ID NO: 355 - protein, 34 aa, Artificial Sequence
  Description of Artificial Sequence: Synthetic polypeptide
DSVKGRFTISSDNAKNTVYLQMNSLKPEDTAVYY

SEQ ID NO: 356 - protein, 34 aa, Artificial Sequence; identical to SEQ ID NO: 355
  Description of Artificial Sequence: Synthetic polypeptide

SEQ ID NO: 357 - protein, 34 aa, Artificial Sequence
  Description of Artificial Sequence: Synthetic polypeptide
DSVKGRFTISRDNAKNMVYLQMNNLKPEDTAVYY

SEQ ID NO: 358 - protein, 34 aa, Artificial Sequence; identical to SEQ ID NO: 357
  Description of Artificial Sequence: Synthetic polypeptide

SEQ ID NO: 359 - protein, 34 aa, Artificial Sequence; identical to SEQ ID NO: 357
  Description of Artificial Sequence: Synthetic polypeptide

SEQ ID NO: 360 - protein, 34 aa, Artificial Sequence
  Description of Artificial Sequence: Synthetic polypeptide
DSVKGRFTISSDNAKTTVYLQMNSLKPEDTALYY

SEQ ID NO: 361 - protein, 34 aa, Artificial Sequence; identical to SEQ ID NO: 360
  Description of Artificial Sequence: Synthetic polypeptide

SEQ ID NO: 362 - protein, 34 aa, Artificial Sequence
  Description of Artificial Sequence: Synthetic polypeptide
DSVNGRFTISRDNAKNTLYLQMNNLKPEDTAVYY

SEQ ID NO: 363 - protein, 34 aa, Artificial Sequence
  Description of Artificial Sequence: Synthetic polypeptide
DAFKGRFAFSLETSASTAYLQINNLKNEDTATYF

SEQ ID NO: 364 - protein, 34 aa, Artificial Sequence
  Description of Artificial Sequence: Synthetic polypeptide
DSVKGRFTISRDNSKNSLYLQMNSLRAEDTAVYY

SEQ ID NO: 365 - protein, 34 aa, Artificial Sequence
  Description of Artificial Sequence: Synthetic polypeptide
DSVAGRFTISRDSAWKALYLQMNSLKPGDTAVYF

SEQ ID NO: 366 - protein, 34 aa, Artificial Sequence; identical to SEQ ID NO: 347
  Description of Artificial Sequence: Synthetic polypeptide

SEQ ID NO: 367 - protein, 34 aa, Artificial Sequence; identical to SEQ ID NO: 347
  Description of Artificial Sequence: Synthetic polypeptide

SEQ ID NO: 368 - protein, 34 aa, Artificial Sequence; identical to SEQ ID NO: 347
  Description of Artificial Sequence: Synthetic polypeptide

SEQ ID NO: 369 - protein, 34 aa, Artificial Sequence; identical to SEQ ID NO: 347
  Description of Artificial Sequence: Synthetic polypeptide

SEQ ID NO: 370 - protein, 34 aa, Artificial Sequence; identical to SEQ ID NO: 347
  Description of Artificial Sequence: Synthetic polypeptide

SEQ ID NO: 371 - protein, 34 aa, Artificial Sequence
  Description of Artificial Sequence: Synthetic polypeptide
DPVAGRFTISRDSAWKALYLQMNSLKPEDTAVYF

SEQ ID NO: 372 - protein, 34 aa, Artificial Sequence
  Description of Artificial Sequence: Synthetic polypeptide
DSVAGRFAISRDSAWKALYLQMNSLKPEDTAVYF

SEQ ID NO: 373 - protein, 34 aa, Artificial Sequence; identical to SEQ ID NO: 347
  Description of Artificial Sequence: Synthetic polypeptide

SEQ ID NO: 374 - protein, 34 aa, Artificial Sequence
  Description of Artificial Sequence: Synthetic polypeptide
DSVAGRFTISRDSARKALYLQMNSLKPEDTAVYF

SEQ ID NO: 375 - protein, 34 aa, Artificial Sequence; identical to SEQ ID NO: 347
  Description of Artificial Sequence: Synthetic polypeptide

SEQ ID NO: 376 - protein, 34 aa, Artificial Sequence; identical to SEQ ID NO: 347
  Description of Artificial Sequence: Synthetic polypeptide

SEQ ID NO: 377 - protein, 34 aa, Artificial Sequence
  Description of Artificial Sequence: Synthetic polypeptide
DSVAGRLTISRDSAWKALYLQMNSLKPEDTAVYF

SEQ ID NO: 378 - protein, 34 aa, Artificial Sequence
  Description of Artificial Sequence: Synthetic polypeptide
DSVAGRFTISRDGAWKALYLQMNSLKPEDTAVYF

SEQ ID NO: 379 - protein, 34 aa, Artificial Sequence; identical to SEQ ID NO: 347
  Description of Artificial Sequence: Synthetic polypeptide

SEQ ID NO: 380 - protein, 34 aa, Artificial Sequence; identical to SEQ ID NO: 347
  Description of Artificial Sequence: Synthetic polypeptide

SEQ ID NO: 381 - protein, 34 aa, Artificial Sequence
  Description of Artificial Sequence: Synthetic polypeptide
DSVAGRFTISRDSAWKALYLQMNSLEPEDTAVYF

SEQ ID NO: 382 - protein, 34 aa, Artificial Sequence; identical to SEQ ID NO: 347
  Description of Artificial Sequence: Synthetic polypeptide

SEQ ID NO: 383 - protein, 34 aa, Artificial Sequence
  Description of Artificial Sequence: Synthetic polypeptide
DSVAGRFTISRDNAWKALYLQMNSLKPEDTAVYF

SEQ ID NO: 384 - protein, 34 aa, Artificial Sequence; identical to SEQ ID NO: 347
  Description of Artificial Sequence: Synthetic polypeptide

SEQ ID NO: 385 - protein, 34 aa, Artificial Sequence; identical to SEQ ID NO: 383
  Description of Artificial Sequence: Synthetic polypeptide

SEQ ID NO: 386 - protein, 34 aa, Artificial Sequence; identical to SEQ ID NO: 347
  Description of Artificial Sequence: Synthetic polypeptide

SEQ ID NO: 387 - protein, 34 aa, Artificial Sequence; identical to SEQ ID NO: 347
  Description of Artificial Sequence: Synthetic polypeptide

SEQ ID NO: 388 - protein, 34 aa, Artificial Sequence; identical to SEQ ID NO: 347
  Description of Artificial Sequence: Synthetic polypeptide

SEQ ID NO: 389 - protein, 34 aa, Artificial Sequence; identical to SEQ ID NO: 347
  Description of Artificial Sequence: Synthetic polypeptide

SEQ ID NO: 390 - protein, 34 aa, Artificial Sequence; identical to SEQ ID NO: 347
  Description of Artificial Sequence: Synthetic polypeptide

SEQ ID NO: 391 - protein, 34 aa, Artificial Sequence; identical to SEQ ID NO: 347
  Description of Artificial Sequence: Synthetic polypeptide

SEQ ID NO: 392 - protein, 34 aa, Artificial Sequence; identical to SEQ ID NO: 346
  Description of Artificial Sequence: Synthetic polypeptide

SEQ ID NO: 393 - protein, 34 aa, Artificial Sequence; identical to SEQ ID NO: 346
  Description of Artificial Sequence: Synthetic polypeptide

SEQ ID NO: 394 - protein, 34 aa, Artificial Sequence; identical to SEQ ID NO: 346
  Description of Artificial Sequence: Synthetic polypeptide

SEQ ID NO: 395 - protein, 34 aa, Artificial Sequence
  Description of Artificial Sequence: Synthetic polypeptide
DSVAGRFTISRGTAWKALYLQMNSLKPEDTAVYF

SEQ ID NO: 396 - protein, 34 aa, Artificial Sequence; identical to SEQ ID NO: 346
  Description of Artificial Sequence: Synthetic polypeptide

SEQ ID NO: 397 - protein, 34 aa, Artificial Sequence; identical to SEQ ID NO: 346
  Description of Artificial Sequence: Synthetic polypeptide

SEQ ID NO: 398 - protein, 34 aa, Artificial Sequence; identical to SEQ ID NO: 346
  Description of Artificial Sequence: Synthetic polypeptide

SEQ ID NO: 399 - protein, 34 aa, Artificial Sequence; identical to SEQ ID NO: 346
  Description of Artificial Sequence: Synthetic polypeptide

SEQ ID NO: 400 - protein, 34 aa, Artificial Sequence; identical to SEQ ID NO: 346
  Description of Artificial Sequence: Synthetic polypeptide

SEQ ID NO: 401 - protein, 34 aa, Artificial Sequence; identical to SEQ ID NO: 346
  Description of Artificial Sequence: Synthetic polypeptide

SEQ ID NO: 402 - protein, 34 aa, Artificial Sequence; identical to SEQ ID NO: 346
  Description of Artificial Sequence: Synthetic polypeptide

SEQ ID NO: 403 - protein, 34 aa, Artificial Sequence; identical to SEQ ID NO: 346
  Description of Artificial Sequence: Synthetic polypeptide

SEQ ID NO: 404 - protein, 34 aa, Artificial Sequence; identical to SEQ ID NO: 346
  Description of Artificial Sequence: Synthetic polypeptide

SEQ ID NO: 405 - protein, 34 aa, Artificial Sequence; identical to SEQ ID NO: 346
  Description of Artificial Sequence: Synthetic polypeptide

SEQ ID NO: 406 - protein, 34 aa, Artificial Sequence; identical to SEQ ID NO: 346
  Description of Artificial Sequence: Synthetic polypeptide

SEQ ID NO: 407 - protein, 34 aa, Artificial Sequence
  Description of Artificial Sequence: Synthetic polypeptide
DSVAGRFTISRDSAWKALYLQMNSLKPEDTAVYL

SEQ ID NO: 408 - protein, 34 aa, Artificial Sequence; identical to SEQ ID NO: 407
  Description of Artificial Sequence: Synthetic polypeptide

SEQ ID NO: 409 - protein, 34 aa, Artificial Sequence; identical to SEQ ID NO: 347
  Description of Artificial Sequence: Synthetic polypeptide

SEQ ID NO: 410 - protein, 34 aa, Artificial Sequence; identical to SEQ ID NO: 347
  Description of Artificial Sequence: Synthetic polypeptide

SEQ ID NO: 411 - protein, 34 aa, Artificial Sequence
  Description of Artificial Sequence: Synthetic polypeptide
DSVAGRFTISRDSAWKALYLQVNSLKPEDTAVYF

SEQ ID NO: 412 - protein, 34 aa, Artificial Sequence
  Description of Artificial Sequence: Synthetic polypeptide
DSVAGRFTISRDSAWKALYLQMDSLKPEDTAVYF

SEQ ID NO: 413 - protein, 34 aa, Artificial Sequence; identical to SEQ ID NO: 347
  Description of Artificial Sequence: Synthetic polypeptide

SEQ ID NO: 414 - protein, 34 aa, Artificial Sequence; identical to SEQ ID NO: 347
  Description of Artificial Sequence: Synthetic polypeptide

SEQ ID NO: 415 - protein, 34 aa, Artificial Sequence
  Description of Artificial Sequence: Synthetic polypeptide
DSVKGRFTISRDNEKNTTYLQMNSLKPEDTAVYY

SEQ ID NO: 416 - protein, 34 aa, Artificial Sequence
  Description of Artificial Sequence: Synthetic polypeptide
DSAKGRFTISRDNAKNMAYLQMNSLKPEDTAVYY

SEQ ID NO: 417 - protein, 34 aa, Artificial Sequence
  Description of Artificial Sequence: Synthetic polypeptide
DSVKGRFIISRDNAKKMGYLQMNSLKPEDTAVYY

SEQ ID NO: 418 - protein, 34 aa, Artificial Sequence; identical to SEQ ID NO: 353
  Description of Artificial Sequence: Synthetic polypeptide

SEQ ID NO: 419 - protein, 34 aa, Artificial Sequence
  Description of Artificial Sequence: Synthetic polypeptide
DSVKGRFIIARDNTKNRAYLQMSSLKPEDTAVYY

SEQ ID NO: 420 - protein, 34 aa, Artificial Sequence; identical to SEQ ID NO: 352
  Description of Artificial Sequence: Synthetic polypeptide

SEQ ID NO: 421 - protein, 34 aa, Artificial Sequence; identical to SEQ ID NO: 352
  Description of Artificial Sequence: Synthetic polypeptide

SEQ ID NO: 422 - protein, 34 aa, Artificial Sequence; identical to SEQ ID NO: 352
  Description of Artificial Sequence: Synthetic polypeptide

SEQ ID NO: 423 - protein, 34 aa, Artificial Sequence
  Description of Artificial Sequence: Synthetic polypeptide
DSVKGRFIISRDNTKNRAYLQMNSLKPEDTAVYY

SEQ ID NO: 424 - protein, 34 aa, Artificial Sequence; identical to SEQ ID NO: 354
  Description of Artificial Sequence: Synthetic polypeptide

SEQ ID NO: 425 - protein, 34 aa, Artificial Sequence; identical to SEQ ID NO: 423
  Description of Artificial Sequence: Synthetic polypeptide

SEQ ID NO: 426 - protein, 34 aa, Artificial Sequence; identical to SEQ ID NO: 355
  Description of Artificial Sequence: Synthetic polypeptide

SEQ ID NO: 427 - protein, 34 aa, Artificial Sequence; identical to SEQ ID NO: 355
  Description of Artificial Sequence: Synthetic polypeptide

SEQ ID NO: 428 - protein, 34 aa, Artificial Sequence
  Description of Artificial Sequence: Synthetic polypeptide
DSVEGRFTISRDNAKNMVYLQMNSLKPEDTAVYY

SEQ ID NO: 429 - protein, 34 aa, Artificial Sequence; identical to SEQ ID NO: 357
  Description of Artificial Sequence: Synthetic polypeptide

SEQ ID NO: 430 - protein, 34 aa, Artificial Sequence; identical to SEQ ID NO: 362
  Description of Artificial Sequence: Synthetic polypeptide

SEQ ID NO: 431 - protein, 12 aa, Artificial Sequence
  Description of Artificial Sequence: Synthetic peptide
CNMESLSYRHYW

SEQ ID NO: 432 - protein, 12 aa, Artificial Sequence
  Description of Artificial Sequence: Synthetic peptide
CNMESLSYRHYW

SEQ ID NO: 433 - protein, 12 aa, Artificial Sequence
  Description of Artificial Sequence: Synthetic peptide
CNMESVRYRNYW

SEQ ID NO: 434 - protein, 12 aa, Artificial Sequence
  Description of Artificial Sequence: Synthetic peptide
CNMESLSYRHYW

SEQ ID NO: 435 - protein, 12 aa, Artificial Sequence
  Description of Artificial Sequence: Synthetic peptide
CNMETFSYRNYW

SEQ ID NO: 436 - protein, 21 aa, Artificial Sequence
  Description of Artificial Sequence: Synthetic peptide
CTAADPKDDCSVPGYYGLNYW

SEQ ID NO: 437 - protein, 21 aa, Artificial Sequence
  Description of Artificial Sequence: Synthetic peptide
CAAAGPKDDCSVPGYYGLNYW

SEQ ID NO: 438 - protein, 21 aa, Artificial Sequence
  Description of Artificial Sequence: Synthetic peptide
CAAAGPPDDCSVPGYYGLNYW

SEQ ID NO: 439 - protein, 21 aa, Artificial Sequence
  Description of Artificial Sequence: Synthetic peptide
CGAATPDDDCSVPGHYGLNYW

SEQ ID NO: 440 - protein, 21 aa, Artificial Sequence
  Description of Artificial Sequence: Synthetic peptide
CAAAGPPDDCSVPGYYGLNYW

SEQ ID NO: 441 - protein, 16 aa, Artificial Sequence
  Description of Artificial Sequence: Synthetic peptide
CATPSWCSLKADFGSW

SEQ ID NO: 442 - protein, 16 aa, Artificial Sequence
  Description of Artificial Sequence: Synthetic peptide
CAAPSWCSLKADFGSW

SEQ ID NO: 443 - protein, 9 aa, Artificial Sequence
  Description of Artificial Sequence: Synthetic peptide
CNVYYRDLW

SEQ ID NO: 444 - protein, 9 aa, Artificial Sequence
  Description of Artificial Sequence: Synthetic peptide
CNVYYRDLW

SEQ ID NO: 445 - protein, 9 aa, Artificial Sequence
  Description of Artificial Sequence: Synthetic peptide
CNVYYRGLW

SEQ ID NO: 446 - protein, 12 aa, Artificial Sequence
  Description of Artificial Sequence: Synthetic peptide
CNLQTISYHDFW

SEQ ID NO: 447 - protein, 12 aa, Artificial Sequence
  Description of Artificial Sequence: Synthetic peptide
CNLQTISYHDFW

SEQ ID NO: 448 - protein, 12 aa, Artificial Sequence
  Description of Artificial Sequence: Synthetic peptide
CKFERYDYVNYW

SEQ ID NO: 449 - protein, 13 aa, Artificial Sequence
  Description of Artificial Sequence: Synthetic peptide
CARDYGDYGMDYW

SEQ ID NO: 450 - protein, 17 aa, Artificial Sequence
  Description of Artificial Sequence: Synthetic peptide
CARDAGYSNHVPIFDSW

SEQ ID NO: 451 - protein, 12 aa, Artificial Sequence
  Description of Artificial Sequence: Synthetic peptide
CNMETFSYRNYW

SEQ ID NO: 452 - protein, 12 aa, Artificial Sequence
  Description of Artificial Sequence: Synthetic peptide
CNMETFSYRNYW

SEQ ID NO: 453 - protein, 12 aa, Artificial Sequence
  Description of Artificial Sequence: Synthetic peptide
CNMETFSYRNYW

SEQ ID NO: 454 - protein, 12 aa, Artificial Sequence
  Description of Artificial Sequence: Synthetic peptide
CNMETFSYRNYW

SEQ ID NO: 455 - protein, 12 aa, Artificial Sequence
  Description of Artificial Sequence: Synthetic peptide
CNMETFSYRNYW

SEQ ID NO: 456 - protein, 12 aa, Artificial Sequence
  Description of Artificial Sequence: Synthetic peptide
CNMETFSYRNYW

SEQ ID NO: 457 - protein, 12 aa, Artificial Sequence
  Description of Artificial Sequence: Synthetic peptide
CNMETFSYRNYW

SEQ ID NO: 458 - protein, 12 aa, Artificial Sequence
  Description of Artificial Sequence: Synthetic peptide
CNMETFSYRNYW

SEQ ID NO: 459 - protein, 12 aa, Artificial Sequence
  Description of Artificial Sequence: Synthetic peptide
CNMETFSYRNYW

SEQ ID NO: 460 - protein, 12 aa, Artificial Sequence
  Description of Artificial Sequence: Synthetic peptide
CNMETFSYRNYW

SEQ ID NO: 461 - protein, 12 aa, Artificial Sequence
  Description of Artificial Sequence: Synthetic peptide
CNMESVRYRNYW

SEQ ID NO: 462 - protein, 12 aa, Artificial Sequence
  Description of Artificial Sequence: Synthetic peptide
CNMESVRYRNYW

SEQ ID NO: 463 - protein, 12 aa, Artificial Sequence
  Description of Artificial Sequence: Synthetic peptide
CNMESVRYRNYW

SEQ ID NO: 464 - protein, 12 aa, Artificial Sequence
  Description of Artificial Sequence: Synthetic peptide
CNMESVRYRNYW

SEQ ID NO: 465 - protein, 12 aa, Artificial Sequence
  Description of Artificial Sequence: Synthetic peptide
CNMESVRYRNYW

SEQ ID NO: 466 - protein, 12 aa, Artificial Sequence
  Description of Artificial Sequence: Synthetic peptide
CNMESVRYRNYW

SEQ ID NO: 467 - protein, 12 aa, Artificial Sequence
  Description of Artificial Sequence: Synthetic peptide
CNMESVRYRNYW

SEQ ID NO: 468 - protein, 12 aa, Artificial Sequence
  Description of Artificial Sequence: Synthetic peptide
CNMESVRYRNYW

SEQ ID NO: 469 - protein, 12 aa, Artificial Sequence
  Description of Artificial Sequence: Synthetic peptide
CNMESVRYRNYW

SEQ ID NO: 470 - protein, 12 aa, Artificial Sequence
  Description of Artificial Sequence: Synthetic peptide
CNMESVRYRNYW

SEQ ID NO: 471 - protein, 12 aa, Artificial Sequence
  Description of Artificial Sequence: Synthetic peptide
CNMESVRYRNYW

SEQ ID NO: 472 - protein, 12 aa, Artificial Sequence
  Description of Artificial Sequence: Synthetic peptide
CNMESVRYRNYW

SEQ ID NO: 473 - protein, 12 aa, Artificial Sequence
  Description of Artificial Sequence: Synthetic peptide
CNMESVRYRNYW

SEQ ID NO: 474 - protein, 12 aa, Artificial Sequence
  Description of Artificial Sequence: Synthetic peptide
CNMESVRYRNYW

SEQ ID NO: 475 - protein, 12 aa, Artificial Sequence
  Description of Artificial Sequence: Synthetic peptide
CNMESVRYRNYW

SEQ ID NO: 476 - protein, 12 aa, Artificial Sequence
  Description of Artificial Sequence: Synthetic peptide
CNMESVRYRNYW

SEQ ID NO: 477 - protein, 12 aa, Artificial Sequence
  Description of Artificial Sequence: Synthetic peptide
CNMESVRYRNYW

SEQ ID NO: 478 - protein, 12 aa, Artificial Sequence
  Description of Artificial Sequence: Synthetic peptide
CNMESLSYRHYW

SEQ ID NO: 479 - protein, 12 aa, Artificial Sequence
  Description of Artificial Sequence: Synthetic peptide
CNMESLSYRHYW

SEQ ID NO: 480 - protein, 12 aa, Artificial Sequence
  Description of Artificial Sequence: Synthetic peptide
CNMESLSYRHYW

SEQ ID NO: 481 - protein, 12 aa, Artificial Sequence
  Description of Artificial Sequence: Synthetic peptide
CNMESLSYRHYW

SEQ ID NO: 482 - protein, 12 aa, Artificial Sequence
  Description of Artificial Sequence: Synthetic peptide
CNMESLSYRHYW

SEQ ID NO: 483 - protein, 12 aa, Artificial Sequence
  Description of Artificial Sequence: Synthetic peptide
CNMESLSYRHYW

SEQ ID NO: 484 - protein, 12 aa, Artificial Sequence
  Description of Artificial Sequence: Synthetic peptide
CNMESLSYRHYW

SEQ ID NO: 485 - protein, 12 aa, Artificial Sequence
  Description of Artificial Sequence: Synthetic peptide
CNMESLSYRHYW

SEQ ID NO: 486 - protein, 12 aa, Artificial Sequence
  Description of Artificial Sequence: Synthetic peptide
CNMESLSYRHYW

SEQ ID NO: 487 - protein, 12 aa, Artificial Sequence
  Description of Artificial Sequence: Synthetic peptide
CNMESLSYRHYW

SEQ ID NO: 488 - protein, 12 aa, Artificial Sequence
  Description of Artificial Sequence: Synthetic peptide
CNMESLSYRHYW

SEQ ID NO: 489 - protein, 12 aa, Artificial Sequence
  Description of Artificial Sequence: Synthetic peptide
CNMESLSYRHYW

SEQ ID NO: 490 - protein, 12 aa, Artificial Sequence
  Description of Artificial Sequence: Synthetic peptide
CNMESLSYRHYW

SEQ ID NO: 491 - protein, 12 aa, Artificial Sequence
  Description of Artificial Sequence: Synthetic peptide
CNMESLSYRHYW

SEQ ID NO: 492 - protein, 12 aa, Artificial Sequence
  Description of Artificial Sequence: Synthetic peptide
CNMESLSYRHYW

SEQ ID NO: 493 - protein, 12 aa, Artificial Sequence
  Description of Artificial Sequence: Synthetic peptide
CNMESLRYRNYW

SEQ ID NO: 494 - protein, 12 aa, Artificial Sequence
  Description of Artificial Sequence: Synthetic peptide
CNMESLRYRNYW

SEQ ID NO: 495 - protein, 12 aa, Artificial Sequence
  Description of Artificial Sequence: Synthetic peptide
CNMESLRYRHYW

SEQ ID NO: 496 - protein, 12 aa, Artificial Sequence
  Description of Artificial Sequence: Synthetic peptide
CNMESLRYRHYW

SEQ ID NO: 497 - protein, 12 aa, Artificial Sequence
  Description of Artificial Sequence: Synthetic peptide
CNMESLRYRHYW

SEQ ID NO: 498 - protein, 12 aa, Artificial Sequence
  Description of Artificial Sequence: Synthetic peptide
CNMESLRYRHYW

SEQ ID NO: 499 - protein, 12 aa, Artificial Sequence
  Description of Artificial Sequence: Synthetic peptide
CNMESLRYRHYW

SEQ ID NO: 500 - protein, 12 aa, Artificial Sequence
  Description of Artificial Sequence: Synthetic peptide
CNMESLRYRHYW

SEQ ID NO: 501 - protein, 21 aa, Artificial Sequence
  Description of Artificial Sequence: Synthetic peptide
CAAAGPPDDCSVPGYYGLNYW

SEQ ID NO: 502 - protein, 21 aa, Artificial Sequence
  Description of Artificial Sequence: Synthetic peptide
CAAAGPADDCSVHGYYGLNYW

SEQ ID NO: 503 - protein, 21 aa, Artificial Sequence
  Description of Artificial Sequence: Synthetic peptide
CGAATPDDDCSVAGHYGLNYW

SEQ ID NO: 504 - protein, 21 aa, Artificial Sequence
  Description of Artificial Sequence: Synthetic peptide
CGAATPDDDCSVPGHYGLNYW

SEQ ID NO: 505 - protein, 21 aa, Artificial Sequence
  Description of Artificial Sequence: Synthetic peptide
CAAAGPPDDCSVPGYYGLNYW

SEQ ID NO: 506 - protein, 21 aa, Artificial Sequence
  Description of Artificial Sequence: Synthetic peptide
CAAAGPPDDCSVPGYYGLNYW

SEQ ID NO: 507 - protein, 21 aa, Artificial Sequence
  Description of Artificial Sequence: Synthetic peptide
CAAAGPPDDCSVPGYYGLNYW

SEQ ID NO: 508 - protein, 21 aa, Artificial Sequence
  Description of Artificial Sequence: Synthetic peptide
CAAAGPPDDCSVPGYYGLNYW

SEQ ID NO: 509 - protein, 21 aa, Artificial Sequence
  Description of Artificial Sequence: Synthetic peptide
CAAAGPPDDCSVPGYYGLNYW

SEQ ID NO: 510 - protein, 21 aa, Artificial Sequence
  Description of Artificial Sequence: Synthetic peptide
CAAAGPPDDCSVPGYYGLNYW

SEQ ID NO: 511 - protein, 21 aa, Artificial Sequence
  Description of Artificial Sequence: Synthetic peptide
CAAAGPPDDCSVPGYYGLNYW

SEQ ID NO: 512 - protein, 16 aa, Artificial Sequence
  Description of Artificial Sequence: Synthetic peptide
CAAPSWCSLKADFGSW

SEQ ID NO: 513 - protein, 16 aa, Artificial Sequence
  Description of Artificial Sequence: Synthetic peptide
CAAPSWCSLKADFGSW

SEQ ID NO: 514 - protein, 9 aa, Artificial Sequence
  Description of Artificial Sequence: Synthetic peptide
CNVYYRDLW

SEQ ID NO: 515 - protein, 9 aa, Artificial Sequence
  Description of Artificial Sequence: Synthetic peptide
CNVYYRDLW

SEQ ID NO: 516 - protein, 12 aa, Artificial Sequence
  Description of Artificial Sequence: Synthetic peptide
CKFERYDYVNYW

SEQ ID NO: 517 - protein, 10 aa, Artificial Sequence
  Description of Artificial Sequence: Synthetic peptide
GQGTQVTVSS

SEQ ID NO: 518 - protein, 10 aa, Artificial Sequence
  Description of Artificial Sequence: Synthetic peptide
GQGTQVTVSS

SEQ ID NO: 519 - protein, 10 aa, Artificial Sequence
  Description of Artificial Sequence: Synthetic peptide
GQGTQVTVSS

SEQ ID NO: 520 - protein, 10 aa, Artificial Sequence
  Description of Artificial Sequence: Synthetic peptide
GQGTQVTVSS

SEQ ID NO: 521 - protein, 10 aa, Artificial Sequence
  Description of Artificial Sequence: Synthetic peptide
GQGTQVTVSS

SEQ ID NO: 522 - protein, 10 aa, Artificial Sequence
  Description of Artificial Sequence: Synthetic peptide
GKGTQVTVSS

SEQ ID NO: 523 - protein, 10 aa, Artificial Sequence
  Description of Artificial Sequence: Synthetic peptide
GKGTQVTVSS

SEQ ID NO: 524 - protein, 10 aa, Artificial Sequence
  Description of Artificial Sequence: Synthetic peptide
GKGTQVTVSS

SEQ ID NO: 525 - protein, 10 aa, Artificial Sequence
  Description of Artificial Sequence: Synthetic peptide
GKGTQVTVSS

SEQ ID NO: 526 - protein, 10 aa, Artificial Sequence
  Description of Artificial Sequence: Synthetic peptide
GKGTQVTVSS

SEQ ID NO: 527 - protein, 10 aa, Artificial Sequence
  Description of Artificial Sequence: Synthetic peptide
GQGTQVTVSS

SEQ ID NO: 528 - protein, 10 aa, Artificial Sequence
  Description of Artificial Sequence: Synthetic peptide
GQGTQVTVSS

SEQ ID NO: 529 - protein, 10 aa, Artificial Sequence
  Description of Artificial Sequence: Synthetic peptide
GQGTQVTVSS

SEQ ID NO: 530 - protein, 10 aa, Artificial Sequence
  Description of Artificial Sequence: Synthetic peptide
GQGTQVTVSS

SEQ ID NO: 531 - protein, 10 aa, Artificial Sequence
  Description of Artificial Sequence: Synthetic peptide
GQGTQVTVSS

SEQ ID NO: 532 - protein, 10 aa, Artificial Sequence
  Description of Artificial Sequence: Synthetic peptide
GQGTQVTVSS

SEQ ID NO: 533 - protein, 10 aa, Artificial Sequence
  Description of Artificial Sequence: Synthetic peptide
GQGTQVTVSS

SEQ ID NO: 534 - protein, 10 aa, Artificial Sequence
  Description of Artificial Sequence: Synthetic peptide
GRGTQVTVSS

SEQ ID NO: 535 - protein, 10 aa, Artificial Sequence
  Description of Artificial Sequence: Synthetic peptide
GQGTSVTVSS

SEQ ID NO: 536 - protein, 10 aa, Artificial Sequence
  Description of Artificial Sequence: Synthetic peptide
GQGTLVTVSS

SEQ ID NO: 537 - protein, 10 aa, Artificial Sequence
  Description of Artificial Sequence: Synthetic peptide
GQGTQVTVSS

SEQ ID NO: 538 - protein, 10 aa, Artificial Sequence
  Description of Artificial Sequence: Synthetic peptide
GQGTQVTVSS

SEQ ID NO: 539 - protein, 10 aa, Artificial Sequence
  Description of Artificial Sequence: Synthetic peptide
GQGTQVTVSS

SEQ ID NO: 540 - protein, 10 aa, Artificial Sequence
  Description of Artificial Sequence: Synthetic peptide
GQGTQVTVSS

SEQ ID NO: 541 - protein, 10 aa, Artificial Sequence
  Description of Artificial Sequence: Synthetic peptide
GQGTQVTVSS

SEQ ID NO: 542 - protein, 10 aa, Artificial Sequence
  Description of Artificial Sequence: Synthetic peptide
GQGTQVTVSS

SEQ ID NO: 543 - protein, 10 aa, Artificial Sequence
  Description of Artificial Sequence: Synthetic peptide
GQGTQVTVSS

SEQ ID NO: 544 - protein, 10 aa, Artificial Sequence
  Description of Artificial Sequence: Synthetic peptide
GQGTQVTVSS

SEQ ID NO: 545 - protein, 10 aa, Artificial Sequence
  Description of Artificial Sequence: Synthetic peptide
GQGTQVTVSS

SEQ ID NO: 546 - protein, 10 aa, Artificial Sequence
  Description of Artificial Sequence: Synthetic peptide
GQGTQVTVSS

SEQ ID NO: 547 - protein, 10 aa, Artificial Sequence
  Description of Artificial Sequence: Synthetic peptide
GQGTQVTVSS

SEQ ID NO: 548 - protein, 10 aa, Artificial Sequence
  Description of Artificial Sequence: Synthetic peptide
GQGTQVTVSS

SEQ ID NO: 549 - protein, 10 aa, Artificial Sequence
  Description of Artificial Sequence: Synthetic peptide
GQGTQVTVSS

SEQ ID NO: 550 - protein, 10 aa, Artificial Sequence
  Description of Artificial Sequence: Synthetic peptide
GQGTQVTVSS

SEQ ID NO: 551 - protein, 10 aa, Artificial Sequence
  Description of Artificial Sequence: Synthetic peptide
GQGTQVTVSS

SEQ ID NO: 552 - protein, 10 aa, Artificial Sequence
  Description of Artificial Sequence: Synthetic peptide
GQGTQVTVSS

SEQ ID NO: 553 - protein, 10 aa, Artificial Sequence
  Description of Artificial Sequence: Synthetic peptide
GQGTQVTVSS

SEQ ID NO: 554 - protein, 10 aa, Artificial Sequence
  Description of Artificial Sequence: Synthetic peptide
GQGTQVTVSS

SEQ ID NO: 555 - protein, 10 aa, Artificial Sequence
  Description of Artificial Sequence: Synthetic peptide
GQGTQVTVSS

SEQ ID NO: 556 - protein, 10 aa, Artificial Sequence
  Description of Artificial Sequence: Synthetic peptide
GQGTQVTVSS

SEQ ID NO: 557 - protein, 10 aa, Artificial Sequence
  Description of Artificial Sequence: Synthetic peptide
GQGTQVTVSS

SEQ ID NO: 558 - protein, 10 aa, Artificial Sequence
  Description of Artificial Sequence: Synthetic peptide
GQGTQVTVSS

SEQ ID NO: 559 - protein, 10 aa, Artificial Sequence
  Description of Artificial Sequence: Synthetic peptide
GQGTQVTVSS

SEQ ID NO: 560 - protein, 10 aa, Artificial Sequence
  Description of Artificial Sequence: Synthetic peptide
GQGTQVTVSS

SEQ ID NO: 561 - protein, 10 aa, Artificial Sequence
  Description of Artificial Sequence: Synthetic peptide
GQGTQVTVSS

SEQ ID NO: 562 - protein, 10 aa, Artificial Sequence
  Description of Artificial Sequence: Synthetic peptide
GQGTQVTVSS

SEQ ID NO: 563 - protein, 10 aa, Artificial Sequence
  Description of Artificial Sequence: Synthetic peptide
GQGTQVTVSS

SEQ ID NO: 564 - protein, 10 aa, Artificial Sequence
  Description of Artificial Sequence: Synthetic peptide
GQGTQVTVSS

SEQ ID NO: 565 - protein, 10 aa, Artificial Sequence
  Description of Artificial Sequence: Synthetic peptide
GQGTQVTVSS

SEQ ID NO: 566 - protein, 10 aa, Artificial Sequence
  Description of Artificial Sequence: Synthetic peptide
GQGTQVTVSS

SEQ ID NO: 567 - protein, 10 aa, Artificial Sequence
  Description of Artificial Sequence: Synthetic peptide
GQGTQVTVSS

SEQ ID NO: 568 - protein, 10 aa, Artificial Sequence
  Description of Artificial Sequence: Synthetic peptide
GQGTQVTVSS

SEQ ID NO: 569 - protein, 10 aa, Artificial Sequence
  Description of Artificial Sequence: Synthetic peptide
GQGTQVTVSS

SEQ ID NO: 570 - protein, 10 aa, Artificial Sequence
  Description of Artificial Sequence: Synthetic peptide
GQGTQVTVSS

SEQ ID NO: 571 - protein, 10 aa, Artificial Sequence
  Description of Artificial Sequence: Synthetic peptide
GQGTQVTVSS

SEQ ID NO: 572 - protein, 10 aa, Artificial Sequence
  Description of Artificial Sequence: Synthetic peptide
GKGTQVTVSS

SEQ ID NO: 573 - protein, 10 aa, Artificial Sequence
  Description of Artificial Sequence: Synthetic peptide
GQGTQVTVSS

SEQ ID NO: 574 - protein, 10 aa, Artificial Sequence
  Description of Artificial Sequence: Synthetic peptide
GQGTQVTVSS

SEQ ID NO: 575 - protein, 10 aa, Artificial Sequence
  Description of Artificial Sequence: Synthetic peptide
GQGTQVTVSS

SEQ ID NO: 576 - protein, 10 aa, Artificial Sequence
  Description of Artificial Sequence: Synthetic peptide
GQGTQVTVSS

SEQ ID NO: 577 - protein, 10 aa, Artificial Sequence
  Description of Artificial Sequence: Synthetic peptide
GQGTQVTVSS

SEQ ID NO: 578 - protein, 10 aa, Artificial Sequence
  Description of Artificial Sequence: Synthetic peptide
GQGTQVTVSS

SEQ ID NO: 579 - protein, 10 aa, Artificial Sequence
  Description of Artificial Sequence: Synthetic peptide
GQGTQVTVSS

SEQ ID NO: 580 - protein, 10 aa, Artificial Sequence
  Description of Artificial Sequence: Synthetic peptide
GQGTQVTVSS

SEQ ID NO: 581 - protein, 10 aa, Artificial Sequence
  Description of Artificial Sequence: Synthetic peptide
GQGTQVTVSS

SEQ ID NO: 582 - protein, 10 aa, Artificial Sequence
  Description of Artificial Sequence: Synthetic peptide
GQGTQVTVSS

SEQ ID NO: 583 - protein, 10 aa, Artificial Sequence
  Description of Artificial Sequence: Synthetic peptide
GQGTQVTVSS

SEQ ID NO: 584 - protein, 10 aa, Artificial Sequence
  Description of Artificial Sequence: Synthetic peptide
GQGTQVTVSS

SEQ ID NO: 585 - protein, 10 aa, Artificial Sequence
  Description of Artificial Sequence: Synthetic peptide
GQGTQVTVSS

SEQ ID NO: 586 - protein, 10 aa, Artificial Sequence
  Description of Artificial Sequence: Synthetic peptide
GQGTQVTVSS

SEQ ID NO: 587 - protein, 10 aa, Artificial Sequence
  Description of Artificial Sequence: Synthetic peptide
GKGTQVTVSS

SEQ ID NO: 588 - protein, 10 aa, Artificial Sequence
  Description of Artificial Sequence: Synthetic peptide
GKGTQVTVSS

SEQ ID NO: 589 - protein, 10 aa, Artificial Sequence
  Description of Artificial Sequence: Synthetic peptide
GKGTQVTVSS

SEQ ID NO: 590 - protein, 10 aa, Artificial Sequence
  Description of Artificial Sequence: Synthetic peptide
GKGTQVTVSS

SEQ ID NO: 591 - protein, 10 aa, Artificial Sequence
  Description of Artificial Sequence: Synthetic peptide
GKGTQVTVSS

SEQ ID NO: 592 - protein, 10 aa, Artificial Sequence
  Description of Artificial Sequence: Synthetic peptide
GKGTQVTVSS

SEQ ID NO: 593 - protein, 10 aa, Artificial Sequence
  Description of Artificial Sequence: Synthetic peptide
GQGTQVTVSS

SEQ ID NO: 594 - protein, 10 aa, Artificial Sequence
  Description of Artificial Sequence: Synthetic peptide
GKGTQVTVSS

SEQ ID NO: 595 - protein, 10 aa, Artificial Sequence
  Description of Artificial Sequence: Synthetic peptide
GKGTQVTVSS

SEQ ID NO: 596 - protein, 10 aa, Artificial Sequence
  Description of Artificial Sequence: Synthetic peptide
GKGTQVTVSS

SEQ ID NO: 597 - protein, 10 aa, Artificial Sequence
  Description of Artificial Sequence: Synthetic peptide
GKGTQVTVSS

SEQ ID NO: 598 - protein, 10 aa, Artificial Sequence
  Description of Artificial Sequence: Synthetic peptide
GQGTQVTVSS

SEQ ID NO: 599 - protein, 10 aa, Artificial Sequence
  Description of Artificial Sequence: Synthetic peptide
GQGTQVTVSS

SEQ ID NO: 600 - protein, 10 aa, Artificial Sequence
  Description of Artificial Sequence: Synthetic peptide
GQGTQVTVSS

SEQ ID NO: 601 - protein, 10 aa, Artificial Sequence
  Description of Artificial Sequence: Synthetic peptide
GQGTQVTVSS

SEQ ID NO: 602 - protein, 10 aa, Artificial Sequence
  Description of Artificial Sequence: Synthetic peptide
GRGTQVTVSS

SEQ ID NO: 603 - protein, 116 aa, Artificial Sequence
  Description of Artificial Sequence: Synthetic polypeptide
QVQLQESGGGLVQTGGSLRLSCTASGSIFDIARGNWYRQAPGKQRELVAIITSGGATNYADSVAGRFTISRDDAKNTVYLQMNGLKPEDTAVYFCNMESLSYRHYWGQGTQVTVSS

SEQ ID NO: 604 - protein, 116 aa, Artificial Sequence
  Description of Artificial Sequence: Synthetic polypeptide
QVQLQESGGGLVQTGGSLRLSCTASGSIFDIARGNWYRQAPGKQRELVAIITSGGATNYADSVAGRFTISRDTAWKALYLQMNSLKPEDTAVYFCNMESLSYRHYWGQGTQVTVSS

SEQ ID NO: 605 - protein, 116 aa, Artificial Sequence
  Description of Artificial Sequence: Synthetic polypeptide
QVQLQESGGGLVQTGGSLRLSCTASGSIFDIVRGSWYRQAPGNQRELVAIITSGGATNYADSVAGRFTISRDSAWKALYLQMNSLKPEDTAVYFCNMESVRYRNYWGQGTQVTVSS

SEQ ID NO: 606 - protein, 116 aa, Artificial Sequence
  Description of Artificial Sequence: Synthetic polypeptide
QVQLQESGGGLVQTGGSLRLSCTASGSTFDIARGNWYRQAPGKQRELVAIITSGGATNYADSVAGRFTISRDTAWKALYLQMNSLKPEDTAVYFCNMESLSYRHYWGQGTQVTVSS

SEQ ID NO: 607 - protein, 116 aa, Artificial Sequence
  Description of Artificial Sequence: Synthetic polypeptide
QVQLQESGGGLVQTGGSLRLSCTASGSIFDIARGNWYRQAPGKQRELVAIITSGGATNYADSVAGRFTISRDSAWKALYLQMNSLKPEDTAVYFCNMETFSYRNYWGQGTQVTVSS

SEQ ID NO: 608 - protein, 126 aa, Artificial Sequence
  Description of Artificial Sequence: Synthetic polypeptide
QVQLQESGGGLVQPGGSLRLSCVASGFTLDRYAVGWFRQAPGKELEGVSCISSSGDIIKYADSAKGRFTIARDNAKNTAYLQMNSLKPEDTAVYYCTAADPKDDCSVPGYYGLNYWGKGTQVTVSS

SEQ ID NO: 609 - protein, 126 aa, Artificial Sequence
  Description of Artificial Sequence: Synthetic polypeptide
QVQLQESGGGLVQPGGSLRLSCVASGFTLDRYSVNWFRQAPGKEREGVTCITSSGDIIKYADSAKGRFTISRDNAKNTAYLEMNSLKPEDTAVYYCAAAGPKDDCSVPGYYGLNYWGKGTQVTVSS

SEQ ID NO: 610 - protein, 126 aa, Artificial Sequence
  Description of Artificial Sequence: Synthetic polypeptide
QVQLQESGGGLVQPGGSLRLSCVASGFTLDKYAIGWFRQAPGKELEGVSCITSSSGVVKYADSVKGRFIISRDNTNNRAFLQMSSLKPEDTAVYYCAAAGPPDDCSVPGYYGLNYWGKGTQVTVSS

SEQ ID NO: 611 - protein, 126 aa, Artificial Sequence
  Description of Artificial Sequence: Synthetic polypeptide
QVQLQESGGGLVQPGGSLRLSCAASGFTLEHYSIGWFRQAPGKDLEGVSCITSSGGIPKYADSVKGRFIISRDNAKNTGYLQMNSLKPEDTAVYYCGAATPDDDCSVPGHYGLNYWGKGTQVTVSS

SEQ ID NO: 612 - protein, 126 aa, Artificial Sequence
  Description of Artificial Sequence: Synthetic polypeptide
QVQLQESGGGLVQPGGSLRLSCTASDFNLERYAINWFRQAPGKEREGVLCITSSGGITKYANSVKGRFIISRDNTKNRAYLQMNSLKPEDTAVYYCAAAGPPDDCSVPGYYGLNYWGKGTQVTVSS

SEQ ID NO: 613 - protein, 121 aa, Artificial Sequence
  Description of Artificial Sequence: Synthetic polypeptide
QVQLQESGGGLVQAGGSLRLSCAAPGFTFDAYAIGWFRQAPGKEREGVICLSPSDGSTYYADSVKGRFTISSDNAKNTVYLQMNSLKPEDTAVYYCATPSWCSLKADFGSWGQGTQVTVSS

SEQ ID NO: 614 - protein, 121 aa, Artificial Sequence
  Description of Artificial Sequence: Synthetic polypeptide
QVQLQESGGGLVQTGGSLRLSCAASGHTFDAYAIGWFRQAPGKEREGVICLSPSDGSTYYADSVKGRFTISSDNAKNTVYLQMNSLKPEDTAVYYCAAPSWCSLKADFGSWGQGTQVTVSS

SEQ ID NO: 615 - protein, 113 aa, Artificial Sequence
  Description of Artificial Sequence: Synthetic polypeptide
QVQLQESGGGLVQAGGSLRLSCAASKSIIRDNVMAWHRQAPGKQRELVAIINTGGSANVDDSVKGRFTISRDNAKNMVYLQMNNLKPEDTAVYYCNVYYRDLWGQGTQVTVSS

SEQ ID NO: 616 - protein, 113 aa, Artificial Sequence
  Description of Artificial Sequence: Synthetic polypeptide
QVQLQESGGGLVQPGGSLRLSCAASKSIIRDNVMAWHRQAPGKQRELVAIINTGGSANVDDSVKGRFTISRDNAKNMVYLQMNNLKPEDTAVYYCNVYYRDLWGQGTQVTVSS

SEQ ID NO: 617 - protein, 113 aa, Artificial Sequence
  Description of Artificial Sequence: Synthetic polypeptide
QVQLQESGGGLVQAGGSLRLSCAASKSIIRDNVMAWHRQAPGKQRELVAIINTGGSANVDDSVKGRFTISRDNAKNMVYLQMNNLKPEDTAVYYCNVYYRGLWGQGTQVTVSS

SEQ ID NO: 618 - protein, 116 aa, Artificial Sequence
  Description of Artificial Sequence: Synthetic polypeptide
QVQLQESGGGLVQPGGSLRLSCVASGSIFSIARMNWYRQAPGKQRELVAILNRAGRTDYADSVKGRFTISSDNAKTTVYLQMNSLKPEDTALYYCNLQTISYHDFWGQGTQVTVSS

SEQ ID NO: 619 - protein, 116 aa, Artificial Sequence
  Description of Artificial Sequence: Synthetic polypeptide
QVQLQESGGGLVQPGGSLRLSCAASGFTLDYYAIAWFRQAPGKQRELVAILNRAGRTDYADSVKGRFTISSDNAKTTVYLQMNSLKPEDTALYYCNLQTISYHDFWGQGTQVTVSS

SEQ ID NO: 620 - protein, 116 aa, Artificial Sequence
  Description of Artificial Sequence: Synthetic polypeptide
QVQLQESGGGLVQPGGSLRLSCTASGSIFSATRMEWYRQAPGKQRELVAIVTSGGRTNYADSVNGRFTISRDNAKNTLYLQMNNLKPEDTAVYYCKFERYDYVNYWGRGTQVTVSS

SEQ ID NO: 621 - protein, 118 aa, Artificial Sequence
  Description of Artificial Sequence: Synthetic polypeptide
QIQLVQSGPEVKKPGETVKISCKASGYTFTNYGMNWVKQAPGKGLKWMGWINTYTGEPTYADAFKGRFAFSLETSASTAYLQINNLKNEDTATYFCARDYGDYGMDYWGQGTSVTVSS

SEQ ID NO: 622 - protein, 122 aa, Artificial Sequence
  Description of Artificial Sequence: Synthetic polypeptide
EVQLVESGGGLVQPGGSLRLSCAASGFTFSVYYMNWVRQAPGKGLEWVSDINNEGGTTYYADSVKGRFTISRDNSKNSLYLQMNSLRAEDTAVYYCARDAGYSNHVPIFDSWGQGTLVTVSS

SEQ ID NO: 623 - protein, 116 aa, Artificial Sequence
  Description of Artificial Sequence: Synthetic polypeptide
QVQLQESGGGLVQPGGSLRLSCTASGSIFDIARGNWYRQAPGKQRELVAIITSGGATNYADSVAGRFTISRDSAWKALYLQMNSLKPGDTAVYFCNMETFSYRNYWGQGTQVTVSS

SEQ ID NO: 624 - protein, 116 aa, Artificial Sequence
  Description of Artificial Sequence: Synthetic polypeptide
QVQLQESGGGLVQPGGSLRLSCTASGSIFDIARGNWYRQAPGKQRELVAIITSGDATNYADSVAGRFTISRDSAWKALYLQMNSLKPEDTAVYFCNMETFSYRNYWGQGTQVTVSS

SEQ ID NO: 625 - protein, 116 aa, Artificial Sequence; identical to SEQ ID NO: 624
  Description of Artificial Sequence: Synthetic polypeptide

SEQ ID NO: 626 - protein, 116 aa, Artificial Sequence; identical to SEQ ID NO: 624
  Description of Artificial Sequence: Synthetic polypeptide

SEQ ID NO: 627 - protein, 116 aa, Artificial Sequence
  Description of Artificial Sequence: Synthetic polypeptide
QVQLQESGGGLVQPGGSLRLSCTASGSIFDIARGNWYRQAPGKQRELVAIITSGGATDYADSVAGRFTISRDSAWKALYLQMNSLKPEDTAVYFCNMETFSYRNYWGQGTQVTVSS

SEQ ID NO: 628 - protein, 116 aa, Artificial Sequence
  Description of Artificial Sequence: Synthetic polypeptide
QVQLQESGGGLVQPGGSLRLSCAASGSIFDIARGNWYRQAPGKQRELVAIITSGGATNYADSVAGRFTISRDSAWKALYLQMNSLKPEDTAVYFCNMETFSYRNYWGQGTQVTVSS

SEQ ID NO: 629 - protein, 116 aa, Artificial Sequence
  Description of Artificial Sequence: Synthetic polypeptide
QVQLQESGGGLVQTGGSLRLSCTASGSIFDIARGNWYRQAPGKQRELVAIITSGGATNYADPVAGRFTISRDSAWKALYLQMNSLKPEDTAVYFCNMETFSYRNYWGQGTQVTVSS

SEQ ID NO: 630 - protein, 116 aa, Artificial Sequence
  Description of Artificial Sequence: Synthetic polypeptide
QVQLQESGGGLVQTGGSLRLSCTASGSIFDIARGNWYRQAPGKQRELVAIITSGGATNYADSVAGRFAISRDSAWKALYLQMNSLKPEDTAVYFCNMETFSYRNYWGQGTQVTVSS

SEQ ID NO: 631 - protein, 116 aa, Artificial Sequence; identical to SEQ ID NO: 607
  Description of Artificial Sequence: Synthetic polypeptide

SEQ ID NO: 632 - protein, 116 aa, Artificial Sequence
  Description of Artificial Sequence: Synthetic polypeptide
QVQLQESGGGLVQTGGSLRLSCTASGSIFDIARGNWYRQAPGKQRELVAIITSGGATNYADSVAGRFTISRDSARKALYLQMNSLKPEDTAVYFCNMETFSYRNYWGQGTQVTVSS

SEQ ID NO: 633 - protein, 116 aa, Artificial Sequence
  Description of Artificial Sequence: Synthetic polypeptide
QVQLQESGGGLVHAGGSLRLSCAVSGSIFDIVRGSWYRQAPGNQRELVAIITSGGATNYADSVAGRFTISRDSAWKALYLQMNSLKPEDTAVYFCNMESVRYRNYWGQGTQVTVSS

SEQ ID NO: 634 - protein, 116 aa, Artificial Sequence
  Description of Artificial Sequence: Synthetic polypeptide
QVQLQESGGGLVQSEGSLRLSCAASGSIFDIVRGSWYRQAPGNQRELVAIITSGGATNYADSVAGRFTISRDSAWKALYLQMNSLKPEDTAVYFCNMESVRYRNYWGQGTQVTVSS

SEQ ID NO: 635 - protein, 116 aa, Artificial Sequence
  Description of Artificial Sequence: Synthetic polypeptide
QVQLQESGGGLVQTGGSLRLSCTASGSIFDIVRGSWYRQAPGNQRELVAIITSGGATNYADSVAGRLTISRDSAWKALYLQMNSLKPEDTAVYFCNMESVRYRNYWGQGTQVTVSS

SEQ ID NO: 636 - protein, 116 aa, Artificial Sequence
  Description of Artificial Sequence: Synthetic polypeptide
QVQLQESGGGLVQTGGSLRLSCTASGSIFDIVRGSWYRQAPGNQRELVAIITSGGATNYADSVAGRFTISRDGAWKALYLQMNSLKPEDTAVYFCNMESVRYRNYWGQGTQVTVSS

SEQ ID NO: 637 - protein, 116 aa, Artificial Sequence
  Description of Artificial Sequence: Synthetic polypeptide
QVQLQESGGGLVQTGGSLRLSCTASGSIFDIVRGSWYRQVPGNQRELVAIITSGGATNYADSVAGRFTISRDSAWKALYLQMNSLKPEDTAVYFCNMESVRYRNYWGQGTQVTVSS

SEQ ID NO: 638 - protein, 116 aa, Artificial Sequence
  Description of Artificial Sequence: Synthetic polypeptide
QVQLQESGGGLVQTGGSLRLSCTVSGSIFDIVRGSWYRQAPGNQRELVAIITSGGATNYADSVAGRFTISRDSAWKALYLQMNSLKPEDTAVYFCNMESVRYRNYWGQGTQVTVSS

SEQ ID NO: 639 - protein, 116 aa, Artificial Sequence
  Description of Artificial Sequence: Synthetic polypeptide
QVQLQESGGGLVQTGGSLRLSCTASGSIFDIVRGSWYRQAPGNQRELVAIITSGGATNYADSVAGRFTISRDSAWKALYLQMNSLEPEDTAVYFCNMESVRYRNYWGQGTQVTVSS

SEQ ID NO: 640 - protein, 116 aa, Artificial Sequence
  Description of Artificial Sequence: Synthetic polypeptide
QVQLQESGGGLVQTGGSLRLSCTASGSIFDIVRGNWYRQAPGNQRELVAIITSGGATNYADSVAGRFTISRDSAWKALYLQMNSLKPEDTAVYFCNMESVRYRNYWGQGTQVTVSS

SEQ ID NO: 641 - protein, 116 aa, Artificial Sequence
  Description of Artificial Sequence: Synthetic polypeptide
QVQLQESGGGLVQTGGSLRLSCTASGSIFDIVRGNWYRQAPGNQRELVAIITSGGATNYADSVAGRFTISRDNAWKALYLQMNSLKPEDTAVYFCNMESVRYRNYWGQGTQVTVSS

SEQ ID NO: 642 - protein, 116 aa, Artificial Sequence
  Description of Artificial Sequence: Synthetic polypeptide
QVQLQESGGGLVQAGGSLRLSCTASGSIFDIVRGNWYRQAPGNQRELVAIITSGGATNYADSVAGRFTISRDSAWKALYLQMNSLKPEDTAVYFCNMESVRYRNYWGQGTQVTVSS

SEQ ID NO: 643 - protein, 116 aa, Artificial Sequence
  Description of Artificial Sequence: Synthetic polypeptide
QVQLQESGGGLVQPGGSLRLSCTASGSIFDIVRGNWYRQAPGNQRELVAIITSGGATNYADSVAGRFTISRDNAWKALYLQMNSLKPEDTAVYFCNMESVRYRNYWGQGTQVTVSS

SEQ ID NO: 644 - protein, 116 aa, Artificial Sequence
  Description of Artificial Sequence: Synthetic polypeptide
QVQLQESGGGLVQPGGSLRLSCTASGSIFDIVRGNWYRQAPGNQRELVAIITSGGATNYADSVAGRFTISRDSAWKALYLQMNSLKPEDTAVYFCNMESVRYRNYWGQGTQVTVSS

SEQ ID NO: 645 - protein, 116 aa, Artificial Sequence; identical to SEQ ID NO: 644
  Description of Artificial Sequence: Synthetic polypeptide

SEQ ID NO: 646 - protein, 116 aa, Artificial Sequence
  Description of Artificial Sequence: Synthetic polypeptide
QVQLQESGGGLVQPGGSLRLSCTASGSIFGIVRGSWYRQAPGNQRELVAIITSGGATNYADSVAGRFTISRDSAWKALYLQMNSLKPEDTAVYFCNMESVRYRNYWGQGTQVTVSS

SEQ ID NO: 647 - protein, 116 aa, Artificial Sequence
  Description of Artificial Sequence: Synthetic polypeptide
QVQLQESGGGLAQPGGSLRLSCTASGSIFDIVRGSWYRQAPGNQRELVAIITSGGATNYADSVAGRFTISRDSAWKALYLQMNSLKPEDTAVYFCNMESVRYRNYWGQGTQVTVSS

SEQ ID NO: 648 - protein, 116 aa, Artificial Sequence
  Description of Artificial Sequence: Synthetic polypeptide
QVQLQESGGGLVQSGGSLRLSCTASGSIFDIVRGSWYRQAPGNQRELVAIITSGGATNYADSVAGRFTISRDSAWKALYLQMNSLKPEDTAVYFCNMESVRYRNYWGQGTQVTVSS

SEQ ID NO: 649 - protein, 116 aa, Artificial Sequence
  Description of Artificial Sequence: Synthetic polypeptide
QVQLQESGGGLVQPGGSLRLSCTASGSIFDIVRGSWYRQAPGNQRELVAIITSGGATNYADSVAGRFTISRDSAWKALYLQMNSLKPEDTAVYFCNMESVRYRNYWGQGTQVTVSS

SEQ ID NO: 650 - protein, 116 aa, Artificial Sequence
  Description of Artificial Sequence: Synthetic polypeptide
QVQLQESGGGLVQTGGSLRLSCTASGGIFDIARGNWYRQAPGKQRELVAIITSGGATNYADSVAGRFTISRDTAWKALYLQMNSLKPEDTAVYFCNMESLSYRHYWGQGTQVTVSS

SEQ ID NO: 651 - protein, 116 aa, Artificial Sequence
  Description of Artificial Sequence: Synthetic polypeptide
QVQLQESGGGLVQTGGSLRLSCTASGSIFGIARGNWYRQAPGKQRELVAIITSGGATNYADSVAGRFTISRDTAWKALYLQMNSLKPEDTAVYFCNMESLSYRHYWGQGTQVTVSS

SEQ ID NO: 652 - protein, 116 aa, Artificial Sequence
  Description of Artificial Sequence: Synthetic polypeptide
QVQLQESGGGLVQTGGSLRLSCTASGSIFDIARGNWYRQAPGKQRELVAIVTSGGATNYADSVAGRFTISRDTAWKALYLQMNSLKPEDTAVYFCNMESLSYRHYWGQGTQVTVSS

SEQ ID NO: 653 - protein, 116 aa, Artificial Sequence
  Description of Artificial Sequence: Synthetic polypeptide
QVQLQESGGGLVQTGGSLRLSCTASGSIFDIARGNWYRQAPGKQRELVAIITSGGATNYADSVAGRFTISRGTAWKALYLQMNSLKPEDTAVYFCNMESLSYRHYWGQGTQVTVSS

SEQ ID NO: 654 - protein, 116 aa, Artificial Sequence
  Description of Artificial Sequence: Synthetic polypeptide
QVQLQESGGGLVRTGGSLRLSCTASGSIFDIARGNWYRQAPGKQRELVAIITSGGATNYADSVAGRFTISRDTAWKALYLQMNSLKPEDTAVYFCNMESLSYRHYWGQGTQVTVSS

SEQ ID NO: 655 - protein, 116 aa, Artificial Sequence
  Description of Artificial Sequence: Synthetic polypeptide
QVQLQESGGGLVRPGGSLRLSCTASGSIFDIARGNWYRQAPGKQRELVAIITSGGATNYADSVAGRFTISRDTAWKALYLQMNSLKPEDTAVYFCNMESLSYRHYWGQGTQVTVSS

SEQ ID NO: 656 - protein, 116 aa, Artificial Sequence
  Description of Artificial Sequence: Synthetic polypeptide
QVQLQESGGGLVQPGGSLRLSCTASGSIFDIARGNWYRQAPGKQRELVAIVTSGGATNYADSVAGRFTISRDTAWKALYLQMNSLKPEDTAVYFCNMESLSYRHYWGQGTQVTVSS

SEQ ID NO: 657 - protein, 116 aa, Artificial Sequence
  Description of Artificial Sequence: Synthetic polypeptide
QVQLQESGGGLVQPGESLRLSCTASGSIFDIARGNWYRQAPGKQRELVAIITSGGATNYADSVAGRFTISRDTAWKALYLQMNSLKPEDTAVYFCNMESLSYRHYWGQGTQVTVSS

SEQ ID NO: 658 - protein, 116 aa, Artificial Sequence
  Description of Artificial Sequence: Synthetic polypeptide
QVQLQESGGGLVQPGGSLRLSCTASGSIFDIARGNWYRQAPGKQRELVAIITSGGATNYADSVAGRFTISRDTAWKALYLQMNSLKPEDTAVYFCNMESLSYRHYWGKGTQVTVSS

SEQ ID NO: 659 - protein, 116 aa, Artificial Sequence
  Description of Artificial Sequence: Synthetic polypeptide
QVQLQESGGGLVQPGGSLRLSCTASGSIFDIARGNWYRQAPGKQRELVAIITSGGATNYADSVAGRFTISRDTAWKALYLQMNSLKPEDTAVYFCNMESLSYRHYWGQGTQVTVSS

SEQ ID NO: 660 - protein, 116 aa, Artificial Sequence
  Description of Artificial Sequence: Synthetic polypeptide
QVQLQESGGGSVQPGGSLRLSCTASGSIFDIARGNWYRQAPGKQRELVAIITSGGATNYADSVAGRFTISRDTAWKALYLQMNSLKPEDTAVYFCNMESLSYRHYWGQGTQVTVSS

SEQ ID NO: 661 - protein, 116 aa, Artificial Sequence
  Description of Artificial Sequence: Synthetic polypeptide
QVQLQESGGGLVQAGGSLRLSCTASGSIFDIARGNWYRQAPGKQRELVAIITSGGATNYADSVAGRFTISRDTAWKALYLQMNSLKPEDTAVYFCNMESLSYRHYWGQGTQVTVSS

SEQ ID NO: 662 - protein, 116 aa, Artificial Sequence
  Description of Artificial Sequence: Synthetic polypeptide
QVQLQESGGGSVQAGGSLRLSCTASGSIFDIARGNWYRQAPGKQRELVAIVTSGGATNYADSVAGRFTISRDTAWKALYLQMNSLKPEDTAVYFCNMESLSYRHYWGQGTQVTVSS

SEQ ID NO: 663 - protein, 116 aa, Artificial Sequence
  Description of Artificial Sequence: Synthetic polypeptide
QVQLQESGGGSVQAGGSLRLSCTASGSIFDIARGNWYRQAPGKQRELVAIITSGGATNYADSVAGRFTISRDTAWKALYLQMNSLKPEDTAVYFCNMESLSYRHYWGQGTQVTVSS

SEQ ID NO: 664 - protein, 116 aa, Artificial Sequence
  Description of Artificial Sequence: Synthetic polypeptide
QVQLQESGGGSVQTGGSLRLSCTASGSIFDIARGNWYRQAPGKQRELVAIITSGGATNYADSVAGRFTISRDTAWKALYLQMNSLKPEDTAVYFCNMESLSYRHYWGQGTQVTVSS

SEQ ID NO: 665 - protein, 116 aa, Artificial Sequence
  Description of Artificial Sequence: Synthetic polypeptide
QVQLQESGGGLVHPGGSLRLSCTASGSIFDIVRGSWYRQAPGKQRELVAIITSGGATNYADSVAGRFTISRDSAWKALYLQMNSLKPEDTAVYLCNMESLRYRNYWGQGTQVTVSS

SEQ ID NO: 666 - protein, 116 aa, Artificial Sequence
  Description of Artificial Sequence: Synthetic polypeptide
QVQLQESGGGLVQTGGSLRLSCTASGSIFDIVRGSWYRQAPGKQRELVAIITSGGATNYADSVAGRFTISRDSAWKALYLQMNSLKPEDTAVYLCNMESLRYRNYWGQGTQVTVSS

SEQ ID NO: 667 - protein, 116 aa, Artificial Sequence
  Description of Artificial Sequence: Synthetic polypeptide
QVQLQESGGGLVRPGGSLRLSCTASGSIFDIVRGSWYRQAPGKQRELVAIITSGGATNYADSVAGRFTISRDSAWKALYLQMNSLKPEDTAVYFCNMESLRYRHYWGQGTQVTVSS

SEQ ID NO: 668 - protein, 116 aa, Artificial Sequence
  Description of Artificial Sequence: Synthetic polypeptide
QVQLQESGGGLVQTGGPLRLSCTASGSIFDIVRGSWYRQAPGKQRELVAIITSGGATNYADSVAGRFTISRDSAWKALYLQMNSLKPEDTAVYFCNMESLRYRHYWGQGTQVTVSS

SEQ ID NO: 669 - protein, 116 aa, Artificial Sequence
  Description of Artificial Sequence: Synthetic polypeptide
QVQLQESGGGLVQTGGSLRLSCTASGSIFDIVRGSWYRQAPGKQRELVAIITSGGATNYADSVAGRFTISRDSAWKALYLQVNSLKPEDTAVYFCNMESLRYRHYWGQGTQVTVSS

SEQ ID NO: 670 - protein, 116 aa, Artificial Sequence
  Description of Artificial Sequence: Synthetic polypeptide
QVQLQESGGGLVQTGGSLRLSCTASGSIFDIVRGSWYRQAPGKQRELVAIITSGGATNYADSVAGRFTISRDSAWKALYLQMDSLKPEDTAVYFCNMESLRYRHYWGQGTQVTVSS

SEQ ID NO: 671 - protein, 116 aa, Artificial Sequence
  Description of Artificial Sequence: Synthetic polypeptide
QVQLQESGGGLVQPGGSLRLSCTASGSIFDIVRGSWYRQAPGKQRELVAIITSGGATNYADSVAGRFTISRDSAWKALYLQMNSLKPEDTAVYFCNMESLRYRHYWGQGTQVTVSS

SEQ ID NO: 672 - protein, 116 aa, Artificial Sequence
  Description of Artificial Sequence: Synthetic polypeptide
QVQLQESGGGLVQTGGSLRLSCTASGSIFDIVRGSWYRQAPGKQRELVAIITSGGATNYADSVAGRFTISRDSAWKALYLQMNSLKPEDTAVYFCNMESLRYRHYWGQGTQVTVSS

SEQ ID NO: 673 - protein, 126 aa, Artificial Sequence
  Description of Artificial Sequence: Synthetic polypeptide
QVQLQESGGGLVEPGESLTLSCVASGLSFDRYAIGWFRQAPGKEREGVACISSKGGLTKYADSVKGRFTISRDNEKNTTYLQMNSLKPEDTAVYYCAAAGPPDDCSVPGYYGLNYWGKGTQVTVSS

SEQ ID NO: 674 - protein, 126 aa, Artificial Sequence
  Description of Artificial Sequence: Synthetic polypeptide
QVQLQESGGGLVQPGGSLRLSCAASGFTLERYAVGWFRQAPGKEREGVSCVSSSGDITKYADSAKGRFTISRDNAKNMAYLQMNSLKPEDTAVYYCAAAGPADDCSVHGYYGLNYWGKGTQVTVSS

SEQ ID NO: 675 - protein, 126 aa, Artificial Sequence
  Description of Artificial Sequence: Synthetic polypeptide
QVQLQESGGGLVQPGGSLRLSCAASGFTLEHYSIGWFRQAPGKDLEGVSCITSSGGIPKYADSVKGRFIISRDNAKKMGYLQMNSLKPEDTAVYYCGAATPDDDCSVAGHYGLNYWGKGTQVTVSS

SEQ ID NO: 676 - protein, 126 aa, Artificial Sequence
  Description of Artificial Sequence: Synthetic polypeptide
QVQLQESGGGLVQPGGSLRLSCAASGFTLEHYSMGWFRQAPGKDLEGVSCITSSGGIPKYADSVKGRFIISRDNAKNTGYLQMNSLKPEDTAVYYCGAATPDDDCSVPGHYGLNYWGKGTQVTVSS

SEQ ID NO: 677 - protein, 126 aa, Artificial Sequence
  Description of Artificial Sequence: Synthetic polypeptide
QVQLQESGGGFVQPGGSLQLSCAVSGRSRDYYSINWFRQAPGKEREGVSCISSSGGITKYADSVKGRFIIARDNTKNRAYLQMSSLKPEDTAVYYCAAAGPPDDCSVPGYYGLNYWGKGTQVTVSS

SEQ ID NO: 678 - protein, 126 aa, Artificial Sequence
  Description of Artificial Sequence: Synthetic polypeptide
QVQLQESGGGLVQPGGSLRLSCAVSGFTLEHYTIGWFRQAPGKELEGVSCITSSGGVVKYADSVKGRFIISRDNTNNRAFLQMSSLKPEDTAVYYCAAAGPPDDCSVPGYYGLNYWGKGTQVTVSS

SEQ ID NO: 679 - protein, 126 aa, Artificial Sequence
  Description of Artificial Sequence: Synthetic polypeptide
QVQLQESGGGLVQPGGSLRLSCVAPGFTLDKYAIGWFRQAPGKELEGVSCITSSSGVVKYADSVKGRFIISRDNTNNRAFLQMSSLKPEDTAVYYCAAAGPPDDCSVPGYYGLNYWGQGTQVTVSS

SEQ ID NO: 680 - protein, 126 aa, Artificial Sequence
  Description of Artificial Sequence: Synthetic polypeptide
QVQLQESGGGLVQPGGSLRLSCVASGFTLDKYAIGWFRQAPGKELEGVSCITSSGGVVKYADSVKGRFIISRDNTNNRAFLQMSSLKPEDTAVYYCAAAGPPDDCSVPGYYGLNYWGKGTQVTVSS

SEQ ID NO: 681 - protein, 126 aa, Artificial Sequence
  Description of Artificial Sequence: Synthetic polypeptide
QVQLQESGGGLVQPGGSLRLSCGASDFTLENYAIGWFRQAPGKEREGVSCITSSGGITKYADSVKGRFIISRDNTKNRAYLQMNSLKPEDTAVYYCAAAGPPDDCSVPGYYGLNYWGKGTQVTVSS

SEQ ID NO: 682 - protein, 126 aa, Artificial Sequence; identical to SEQ ID NO: 612
  Description of Artificial Sequence: Synthetic polypeptide

SEQ ID NO: 683 - protein, 126 aa, Artificial Sequence
  Description of Artificial Sequence: Synthetic polypeptide
QVQLQESGGGLVQPGGSLRLSCVASGFTLDYYAINWFRQAPGKEREGVLCITSNGGITKYADSVKGRFIISRDNTKNRAYLQMNSLKPEDTAVYYCAAAGPPDDCSVPGYYGLNYWGKGTQVTVSS

SEQ ID NO: 684 - protein, 121 aa, Artificial Sequence
  Description of Artificial Sequence: Synthetic polypeptide
QVQLQESGGGLVQAGGSLRLSCAASGFTFDAYAIGWFRQAPGKEREGVICLSPSDGSTYYADSVKGRFTISSDNAKNTVYLQMNSLKPEDTAVYYCAAPSWCSLKADFGSWGQGTQVTVSS

SEQ ID NO: 685 - protein, 121 aa, Artificial Sequence
  Description of Artificial Sequence: Synthetic polypeptide
QVQLQESGGGLVQPGGSLRLSCAASGFTFDAYAIGWFRQAPGKEREGVICLSPSDGSTYYADSVKGRFTISSDNAKNTVYLQMNSLKPEDTAVYYCAAPSWCSLKADFGSWGQGTQVTVSS

SEQ ID NO: 686 - protein, 113 aa, Artificial Sequence
  Description of Artificial Sequence: Synthetic polypeptide
QVQLQESGGGLVQAGGSLRLSCAASGSIIRDNVMAWHRQAPGKQRELVAIINIGGSGNVDDSVEGRFTISRDNAKNMVYLQMNSLKPEDTAVYYCNVYYRDLWGQGTQVTVSS

SEQ ID NO: 687 - protein, 113 aa, Artificial Sequence
  Description of Artificial Sequence: Synthetic polypeptide
QVQLQESGGGLVQPGGSLRLSCTASKSIIRDNVMAWHRQAPGKQRELVAIINTGGSANVDDSVKGRFTISRDNAKNMVYLQMNNLKPEDTAVYYCNVYYRDLWGQGTQVTVSS

SEQ ID NO: 688 - protein, 116 aa, Artificial Sequence; identical to SEQ ID NO: 620
  Description of Artificial Sequence: Synthetic polypeptide

SEQ ID NO: 689 - RNA, 6 nt, Artificial Sequence
  Description of Artificial Sequence: Synthetic oligonucleotide
aauaaa

SEQ ID NO: 690 - protein, 10 aa, Artificial Sequence
  Description of Artificial Sequence: Synthetic peptide
GGGGSGGGGS

SEQ ID NO: 691 - DNA, 30 bp, Artificial Sequence
  Description of Artificial Sequence: Synthetic oligonucleotide
ggtggcggaggttctggaggtggaggttcc

SEQ ID NO: 692 - protein, 20 aa, Artificial Sequence
  Description of Artificial Sequence: Synthetic peptide
AAAGGGGSGGGGSGGGGSLE

SEQ ID NO: 693 - protein, 30 aa, Artificial Sequence
  Description of Artificial Sequence: Synthetic polypeptide
AAAIEVMYPPPYLGGGGSGGGGSGGGGSLE

SEQ ID NO: 694 - protein, 207 aa, Homo sapiens
MQSGTHWRVLGLCLLSVGVWGQDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRI

SEQ ID NO: 695 - protein, 22 aa, Homo sapiens
MQSGTHWRVLGLCLLSVGVWGQ

SEQ ID NO: 696 - protein, 104 aa, Homo sapiens
DGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMD

SEQ ID NO: 697 - protein, 26 aa, Homo sapiens
VMSVATIVIVDICITGGLLLLVYYWS

SEQ ID NO: 698 - protein, 55 aa, Homo sapiens
KNRKAKAKPVTRGAGAGGRQRGQNKERPPPVPNPDYEPIRKGQRDLYSGLNQRRI

SEQ ID NO: 699 - protein, 182 aa, Homo sapiens
MEQGKGLAVLILAIILLQGTLAQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRN

SEQ ID NO: 700 - protein, 22 aa, Homo sapiens
MEQGKGLAVLILAIILLQGTLA

SEQ ID NO: 701 - protein, 94 aa, Homo sapiens
QSIKGNHLVKVYDYQEDGSVLLTCDAEAKNITWFKDGKMIGFLTEDKKKWNLGSNAKDPRGMYQCKGSQNKSKPLQVYYRMCQNCIELNAATIS

SEQ ID NO: 702 - protein, 21 aa, Homo sapiens
GFLFAEIVSIFVLAVGVYFIA

SEQ ID NO: 703 - protein, 45 aa, Homo sapiens
GQDGVRQSRASDKQTLLPNDQLYQPLKDREDDQYSHLQGNQLRRN

SEQ ID NO: 704 - protein, 172 aa, Homo sapiens
MEHSTFLSGLVLATLLSQVSPFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKS

SEQ ID NO: 705 - protein, 21 aa, Homo sapiens
MEHSTFLSGLVLATLLSQVSP

SEQ ID NO: 706 - protein, 84 aa, Homo sapiens [sequence omitted]

SEQ ID NO: 707 - protein, 21 aa, Homo sapiens
GIIVTDVIATLLLALGVFCFA

SEQ ID NO: 708 - protein, 45 aa, Homo sapiens
GHETGRLSGAADTQALLRNDQVYQPLRDRDDAQYSHLGGNWARNK

SEQ ID NO: 709 - protein, 164 aa, Homo sapiens
MKWKALFTAAILQAQLPITEAQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 710 - protein, 281 aa, Homo sapiens
MAGTWLLLLLALGCPALPTGVGGTPFPSLAPPIMLLVDGKQQMVVVCLVLDVAPPGLDSPIWFSAGNGSALDAFTYGPSPATDGTWTNLAHLSLPSEELASWEPLVCHTGPGAEGHSRSTQPMHLSGEASTARTCPQEPLRGTPGGALWLGVLRLLLFKLLLFDLLLTCSCLCDPAGPLPSPATTTRLRALGSHRLHPATETGGREATSSPRPQPRDRRWGDTPPGRKPGSPVWGEGSYLSSYPTCPAQAWCSRSALRAPSSSLGAFFAGDLPPPLQAGAA

SEQ ID NO: 711 - protein, 142 aa, Homo sapiens
PNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 712 - protein, 117 aa, Homo sapiens
PNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLS

SEQ ID NO: 713 - protein, 23 aa, Homo sapiens
VIGFRILLLKVAGFNLLMTLRLW

SEQ ID NO: 714 - protein, 139 aa, Homo sapiens
MAMLLGASVLILWLQPDWVNSQQKNDDQQVKQNSPSLSVQEGRISILNCDYTNSMFDYFLWYKKYPAEGPTFLISISSIKDKNEDGRFTVFLNKSAKHLSLHIVPSQPGDSAVYFCAAKGAGTASKLTFGTGTRLQVTL

SEQ ID NO: 715 - protein, 177 aa, Homo sapiens
EDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 716 - protein, 150 aa, Homo sapiens
EDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYE

SEQ ID NO: 717 - protein, 21 aa, Homo sapiens
ILLGKATLYAVLVSALVLMAM

SEQ ID NO: 718 - protein, 133 aa, Homo sapiens
MGTSLLCWMALCLLGADHADTGVSQNPRHNITKRGQNVTFRCDPISEHNRLYWYRQTLGQGPEFLTYFQNEAQLEKSRLLSDRFSAERPKGSFSTLEIQRTEQGDSAMYLCASSLAGLNQPQHFGDGTRLSIL

SEQ ID NO: 719 - protein, 6 aa, Homo sapiens
VKRKDF

SEQ ID NO: 720 - protein, 135 aa, Homo sapiens
MDSWTFCCVSLCILVAKHTDAGVIQSPRHEVTEMGQEVTLRCKPISGHNSLFWYRQTMMRGLELLIYFNNNVPIDDSGMPEDRFSAKMPNASFSTLKIQPSEPRDSAVYFCASSFSTCSANYGYTFGSGTRLTVV

SEQ ID NO: 721 - protein, 173 aa, Homo sapiens
DKQLDADVSPKPTIFLPSIAETKLQKAGTYLCLLEKFFPDVIKIHWQEKKSNTILGSQEGNTMKTNDTYMKFSWLTVPEKSLDKEHRCIVRHENNKNGVDQEIIFPPIKTDVITMDPKDNCSKDANDTLLLQLTNTSAYYMYLLLLLKSVVYFAIITCCLLRRTAFCCNGEKS

SEQ ID NO: 722 - protein, 138 aa, Homo sapiens
DKQLDADVSPKPTIFLPSIAETKLQKAGTYLCLLEKFFPDVIKIHWQEKKSNTILGSQEGNTMKTNDTYMKFSWLTVPEKSLDKEHRCIVRHENNKNGVDQEIIFPPIKTDVITMDPKDNCSKDANDTLLLQLTNTSA

SEQ ID NO: 723 - protein, 23 aa, Homo sapiens
YYMYLLLLLKSVVYFAIITCCLL

SEQ ID NO: 724 - protein, 12 aa, Homo sapiens
RRTAFCCNGEKS

SEQ ID NO: 725 - protein, 153 aa, Homo sapiens
SQPHTKPSVFVMKNGTNVACLVKEFYPKDIRINLVSSKKITEFDPAIVISPSGKYNAVKLGKYEDSNSVTCSVQHDNKTVHSTDFEVKTDSTDHVKPKETENTKQPSKSCHKPKAIVHTEKVNMMSLTVLGLRMLFAKTVAVNFLLTAKLFFL

SEQ ID NO: 726 - protein, 129 aa, Homo sapiens
SQPHTKPSVFVMKNGTNVACLVKEFYPKDIRINLVSSKKITEFDPAIVISPSGKYNAVKLGKYEDSNSVTCSVQHDNKTVHSTDFEVKTDSTDHVKPKETENTKQPSKSCHKPKAIVHTEKVNMMSLTV

SEQ ID NO: 727 - protein, 23 aa, Homo sapiens
LGLRMLFAKTVAVNFLLTAKLFF

SEQ ID NO: 728 - protein, 126 aa, Artificial Sequence
  Description of Artificial Sequence: Synthetic polypeptide
EVQLVESGGGLVQPGGSLRLSCAASGFTLDKYAMGWFRQAPGKELEGVSCITSSSGVVYYADSVKGRFTISRDNAKNTLYLQMNSLRPEDTAVYYCAAAGPPDDCSVPGYYGLNYWGQGTQVTVSS

SEQ ID NO: 729 - protein, 126 aa, Artificial Sequence
  Description of Artificial Sequence: Synthetic polypeptide
EVQLVESGGGLVQPGGSLRLSCAASGFTLDKYAMGWFRQAPGKELEGVSCITSSSGVVYYADSVKGRFTISRDNAKNTLFLQMNSLRPEDTAVYYCAAAGPPDDCSVPGYYGLNYWGQGTQVTVSS

SEQ ID NO: 730 - protein, 126 aa, Artificial Sequence
  Description of Artificial Sequence: Synthetic polypeptide
EVQLVESGGGLVQPGGSLRLSCAASGFTLDKYAMGWFRQAPGKELEGVSCITSSSGVVKYADSVKGRFTISRDNAKNTLFLQMNSLRPEDTAVYYCAAAGPPDDCSVPGYYGLNYWGQGTQVTVSS

SEQ ID NO: 731 - protein, 126 aa, Artificial Sequence
  Description of Artificial Sequence: Synthetic polypeptide
EVQLVESGGGLVQPGGSLRLSCAASGFTLDKYAMGWFRQAPGKELEGVSCITSSSGVVKYADSVKGRFTISRDNTKNTLFLQMNSLRPEDTAVYYCAAAGPPDDCSVPGYYGLNYWGQGTQVTVSS

SEQ ID NO: 732 - protein, 116 aa, Artificial Sequence
  Description of Artificial Sequence: Synthetic polypeptide
EVQLVESGGGLVQPGGSLRLSCAASGSIFDIVRMSWYRQAPGKQRELVSIITSGGATYYADSVKGRFTISRDNAKNALYLQMNSLRPEDTAVYYCNMESVRYRNYWGQGTQVTVSS

SEQ ID NO: 733 - protein, 116 aa, Artificial Sequence
  Description of Artificial Sequence: Synthetic polypeptide
EVQLVESGGGLVQPGGSLRLSCAASGSIFDIVRMSWYRQAPGNQRELVSIITSGGATYYADSVKGRFTISRDNAKNALYLQMNSLRPEDTAVYYCNMESVRYRNYWGQGTQVTVSS

SEQ ID NO: 734 - protein, 116 aa, Artificial Sequence
  Description of Artificial Sequence: Synthetic polypeptide
EVQLVESGGGLVQPGGSLRLSCAASGSIFDIVRMSWYRQAPGNQRELVSIITSGGATYYADSVKGRFTISRDNAWKALYLQMNSLRPEDTAVYYCNMESVRYRNYWGQGTQVTVSS

SEQ ID NO: 735 - protein, 126 aa, Artificial Sequence
  Description of Artificial Sequence: Synthetic polypeptide
EVQLVESGGGLVQPGGSLRLSCAASGFTLEHYSMSWFRQAPGKDLEGVSCITSSGGIPYYADSVKGRFTISRDNAKNTLYLQMNSLKPEDTAVYYCGAATPDDDCSVPGHYGLNYWGQGTLVTVSS

SEQ ID NO: 736 - protein, 126 aa, Artificial Sequence
  Description of Artificial Sequence: Synthetic polypeptide
EVQLVESGGGLVQPGGSLRLSCAASGFTLEHYSMGWFRQAPGKDLEGVSCITSSGGIPYYADSVKGRFTISRDNAKNTLYLQMNSLKPEDTAVYYCGAATPDDDCSVPGHYGLNYWGQGTLVTVSS

SEQ ID NO: 737 - protein, 126 aa, Artificial Sequence
  Description of Artificial Sequence: Synthetic polypeptide
EVQLVESGGGLVQPGGSLRLSCAASGFTLEHYSMGWFRQAPGKDLEGVSCITSSGGIPKYADSVKGRFTISRDNAKNTLYLQMNSLKPEDTAVYYCGAATPDDDCSVPGHYGLNYWGQGTLVTVSS

SEQ ID NO: 738 - protein, 121 aa, Artificial Sequence
  Description of Artificial Sequence: Synthetic polypeptide
EVQLLESGGGLVQPGGSLRLSCAAPGFTFDAYAMSWFRQAPGKEREGVSCLSPSDGSTYYADSVKGRFTISRDNSKNTLYLQMNSLRPEDTAVYYCATPSWCSLKADFGSWGQGTLVTVSS

SEQ ID NO: 739 - protein, 121 aa, Artificial Sequence
  Description of Artificial Sequence: Synthetic polypeptide
EVQLLESGGGLVQPGGSLRLSCAAPGFTFDAYAMGWFRQAPGKEREGVSCLSPSDGSTYYADSVKGRFTISRDNSKNTLYLQMNSLRPEDTAVYYCATPSWCSLKADFGSWGQGTLVTVSS

SEQ ID NO: 740 - protein, 121 aa, Artificial Sequence
  Description of Artificial Sequence: Synthetic polypeptide
EVQLLESGGGLVQPGGSLRLSCAAPGFTFDAYAMGWFRQAPGKEREGVSCLSPSDGSTYYADSVKGRFTISRDNAKNTLYLQMNSLRPEDTAVYYCATPSWCSLKADFGSWGQGTLVTVSS

SEQ ID NO: 741 - protein, 116 aa, Artificial Sequence
  Description of Artificial Sequence: Synthetic polypeptide
EVQLVESGGGLVQPGGSLRLSCAASGSIFSATRMSWYRQAPGKQRELVSIVTSGGRTYYADSVKGRFTISRDNAKNTLYLQMNSLRPEDTAVYYCKFERYDYVNYWGQGTLVTVSS

SEQ ID NO: 742 - protein, 116 aa, Artificial Sequence
  Description of Artificial Sequence: Synthetic polypeptide
EVQLVESGGGLVQPGGSLRLSCAASGSIFSATRMEWYRQAPGKQRELVSIVTSGGRTYYADSVKGRFTISRDNAKNTLYLQMNSLRPEDTAVYYCKFERYDYVNYWGQGTLVTVSS

SEQ ID NO: 743 - protein, 116 aa, Artificial Sequence
  Description of Artificial Sequence: Synthetic polypeptide
EVQLVESGGGLVQPGGSLRLSCAASGSIFSATRMEWYRQAPGKQRELVSIVTSGGRTYYADSVKGRFTISRDNAKNTLYLQMNNLRPEDTAVYYCKFERYDYVNYWGQGTLVTVSS

SEQ ID NO: 744 - DNA, 20 bp, Artificial Sequence
  Description of Artificial Sequence: Synthetic oligonucleotide
gtgcatccagcgcttcgcac

SEQ ID NO: 745 - DNA, 20 bp, Artificial Sequence
  Description of Artificial Sequence: Synthetic oligonucleotide
atcaccaagcccgcgaccaa

SEQ ID NO: 746 - DNA, 20 bp, Artificial Sequence
  Description of Artificial Sequence: Synthetic oligonucleotide
cagctacgtatccatcgtga

SEQ ID NO: 747 - DNA, 20 bp, Artificial Sequence
  Description of Artificial Sequence: Synthetic oligonucleotide
gcccccctgccagtatagcc

SEQ ID NO: 748 - DNA, 20 bp, Artificial Sequence
  Description of Artificial Sequence: Synthetic oligonucleotide
gagctgcagctgaatcacac

SEQ ID NO: 749 - DNA, 20 bp, Artificial Sequence
  Description of Artificial Sequence: Synthetic oligonucleotide
ctcaccccaagtgactcgag

SEQ ID NO: 750 - DNA, 20 bp, Artificial Sequence
  Description of Artificial Sequence: Synthetic oligonucleotide
ttcctacacaatgcgttgcc

SEQ ID NO: 751 - DNA, 20 bp, Artificial Sequence
  Description of Artificial Sequence: Synthetic oligonucleotide
gatattggcataagcctccc

SEQ ID NO: 752 - DNA, 20 bp, Artificial Sequence
  Description of Artificial Sequence: Synthetic oligonucleotide
tcaactgcgaccagttcagc

SEQ ID NO: 753 - DNA, 20 bp, Artificial Sequence
  Description of Artificial Sequence: Synthetic oligonucleotide
catcgctgttaagaagctcc

SEQ ID NO: 754 - DNA, 20 bp, Artificial Sequence
  Description of Artificial Sequence: Synthetic oligonucleotide
gcccctagaaggtggctacc

SEQ ID NO: 755 - DNA, 20 bp, Artificial Sequence
  Description of Artificial Sequence: Synthetic oligonucleotide
tcctacctgtcagagcccca

SEQ ID NO: 756 - protein, 6 aa, Artificial Sequence
  Description of Artificial Sequence: Synthetic peptide
AEKDEL

SEQ ID NO: 757 - protein, 14 aa, Artificial Sequence
  Description of Artificial Sequence: Synthetic peptide
EQKLISEEDLKDEL

SEQ ID NO: 758 - protein, 14 aa, Artificial Sequence
  Description of Artificial Sequence: Synthetic peptide
GGGGSGGGGSKDEL

SEQ ID NO: 759 - protein, 24 aa, Artificial Sequence
  Description of Artificial Sequence: Synthetic peptide
GGGGSGGGGSGGGGSGGGGSKDEL

SEQ ID NO: 760 - protein, 26 aa, Artificial Sequence
  Description of Artificial Sequence: Synthetic peptide
GGGGSGGGGSGGGGSGGGGSAEKDEL

SEQ ID NO: 761 - protein, 15 aa, Artificial Sequence
  Description of Artificial Sequence: Synthetic peptide
KYKSRRSFIEEKKMP

SEQ ID NO: 762 - protein, 16 aa, Artificial Sequence
  Description of Artificial Sequence: Synthetic peptide
LKYKSRRSFIEEKKMP

SEQ ID NO: 763 - protein, 17 aa, Artificial Sequence
  Description of Artificial Sequence: Synthetic peptide
LYKYKSRRSFIEEKKMP

SEQ ID NO: 764 - protein, 18 aa, Artificial Sequence
  Description of Artificial Sequence: Synthetic peptide
LYCKYKSRRSFIEEKKMP

SEQ ID NO: 765 - protein, 19 aa, Artificial Sequence
  Description of Artificial Sequence: Synthetic peptide
LYCNKYKSRRSFIEEKKMP

SEQ ID NO: 766 - protein, 17 aa, Artificial Sequence
  Description of Artificial Sequence: Synthetic peptide
LYKYKSRRSFIDEKKMP

SEQ ID NO: 767 - protein, 19 aa, Artificial Sequence
  Description of Artificial Sequence: Synthetic peptide
LYCNKYKSRRSFIDEKKMP

SEQ ID NO: 768 - protein, 27 aa, Artificial Sequence
  Description of Artificial Sequence: Synthetic peptide
LYEQKLISEEDLKYKSRRSFIEEKKMP

SEQ ID NO: 769 - protein, 27 aa, Artificial Sequence
  Description of Artificial Sequence: Synthetic peptide
LYCYPYDVPDYAKYKSRRSFIEEKKMP

SEQ ID NO: 770 - protein, 12 aa, Artificial Sequence
  Description of Artificial Sequence: Synthetic peptide
LYKKLETFKKTN

SEQ ID NO: 771 - protein, 22 aa, Artificial Sequence
  Description of Artificial Sequence: Synthetic peptide
LYEQKLISEEDLKKLETFKKTN

SEQ ID NO: 772 - protein, 6 aa, Artificial Sequence
  Description of Artificial Sequence: Synthetic peptide
LYYQRL

SEQ ID NO: 773 - protein, 16 aa, Artificial Sequence
  Description of Artificial Sequence: Synthetic peptide
LYEQKLISEEDLYQRL

SEQ ID NO: 774 - protein, 30 aa, Artificial Sequence
  Description of Artificial Sequence: Synthetic polypeptide
LYKRKIIAFALEGKRSKVTRRPKASDYQRL

SEQ ID NO: 775 - protein, 8 aa, Artificial Sequence
  Description of Artificial Sequence: Synthetic peptide
LYRNIKCD

SEQ ID NO: 776 - protein, 18 aa, Artificial Sequence
  Description of Artificial Sequence: Synthetic peptide
LYEQKLISEEDLRNIKCD

SEQ ID NO: 777 - protein, 4 aa, Artificial Sequence
  Description of Artificial Sequence: Synthetic peptide
KDEL

SEQ ID NO: 778 - protein, 15 aa, Artificial Sequence
  Description of Artificial Sequence: Synthetic peptide
KYKSRRSFIDEKKMP

SEQ ID NO: 779 - protein, 10 aa, Artificial Sequence
  Description of Artificial Sequence: Synthetic peptide
MHRRRSRSCR

SEQ ID NO: 780 - protein, 163 aa, Artificial Sequence
  Description of Artificial Sequence: Synthetic polypeptide
MALPVTALLLPLALLLHAARPQVQLQESGGGLVQAGGSLRLSCTASGSIFSATRMEWYRQAPGKQRELVAIVTSGGRTNYADSVNGRFTISRDNAKNTLYLQMNNLKPEDTAVYYCKFERYDYVNYWGRGTQVTVSSGGGGSGGGGSGGGGSGGGGSAEKDEL

SEQ ID NO: 781 - protein, 222 aa, Artificial Sequence
  Description of Artificial Sequence: Synthetic polypeptide
MALPVTALLLPLALLLHAARPQVQLQESGGGLVQAGGSLRLSCTASGSIFSATRMEWYRQAPGKQRELVAIVTSGGRTNYADSVNGRFTISRDNAKNTLYLQMNNLKPEDTAVYYCKFERYDYVNYWGRGTQVTVSSTTTPAPRPPTPAPTIASQPLSLRPEACRPAAGGAVHTRGLDFACDIYIWAPLAGTCGVLLLSLVITLYLYKYKSRRSFIDEKKMP

SEQ ID NO: 782 - protein, 12 aa, Artificial Sequence
  Description of Artificial Sequence: Synthetic peptide
GGSGGSGGSGGS

SEQ ID NO: 783 - protein, 126 aa, Artificial Sequence
  Description of Artificial Sequence: Synthetic polypeptide
QVQLVQSGAEVKRPGASVKVSCKASGYTFTSYYMHWVRQAPGQGLEWMGIINPSGGSTSYAQKFQGRVTMTRDTSTSTVYMELSSLRSEDTAVYYCAIEPGYCSGGSCYPDAFDIWGQGTTVTVSS

SEQ ID NO: 784 - protein, 120 aa, Artificial Sequence
  Description of Artificial Sequence: Synthetic polypeptide
QVQLVESGGGVVQPGGSLRLSCAASGFTFSSYAMHWVRQAPGKGLEWVAVISYDGSNKYYADSVKGRFTISRDNSKNTLYLQMNSLRAEDTAVYYCARDGHPYYYGMDVWGQGTTVTVSS

SEQ ID NO: 785 - protein, 121 aa, Artificial Sequence
  Description of Artificial Sequence: Synthetic polypeptide
QVQLVQSGAEVKKPGSSVKVSCKASGGTFSSYAISWVRQAPGQGLEWMGWISAYNGNTNYAQKLQGRVTMTTDTSTSTAYMELRSLRSDDTAVYYCARVTPPGWLGNMDVWGKGTTVTVSS

SEQ ID NO: 786 - protein, 127 aa, Artificial Sequence
  Description of Artificial Sequence: Synthetic polypeptide
QVQLVQSGAEVKKPGASVKVSCKASGYTFTGYYMNWVRQAPGQGLEWMAWINPNTGDTNYAQKFQGRVTMTRDTSINTAYIELSRLTSDDTAVYYCARVGDYYDRSGYYRHDAFDIWGQGTMVTVSS

SEQ ID NO: 787 - protein, 112 aa, Artificial Sequence
  Description of Artificial Sequence: Synthetic polypeptide
QMQLVQSGAEVKKPGSSVKVSCKASGGTFSSYAISWVRQAPGQGLEWMGWISAYNGNTNYAQKLQGRVTMTTDTSTSTAYMELRSLRSDDTAVYYCARDDYWGQGTLVTVSS

SEQ ID NO: 788 - protein, 118 aa, Artificial Sequence
  Description of Artificial Sequence: Synthetic polypeptide
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARSRRPYWYFDLWGRGTLVTVSS

SEQ ID NO: 789 - protein, 123 aa, Artificial Sequence
  Description of Artificial Sequence: Synthetic polypeptide
EVQLVQSGGGVVQPGRSLRLSCAASGFTFSSYAMHWVRQAPGKGLEWVAVISYDGSNKYYADSVKGRFTISRDNSKNTLYLQMNSLRAEDTAVYYCATNSGYDSDYYYGMDVWGQGTTVTVSS

SEQ ID NO: 790 - protein, 118 aa, Artificial Sequence; identical to SEQ ID NO: 788
  Description of Artificial Sequence: Synthetic polypeptide

SEQ ID NO: 791 - protein, 118 aa, Artificial Sequence; identical to SEQ ID NO: 788
  Description of Artificial Sequence: Synthetic polypeptide

SEQ ID NO: 792 - protein, 122 aa, Artificial Sequence
  Description of Artificial Sequence: Synthetic polypeptide
EVQLVQSGGGVVQPGRSLRLSCAASGFTFSSYGMHWVRQAPGKGLEWVAVISYDGSNKYYADSVKGRFTISRDNSKNTLYLQMNSLRAEDTAVYYCAKAGAPPHYYYGMDVWGQGTTVTVSS

SEQ ID NO: 793 - protein, 120 aa, Artificial Sequence
  Description of Artificial Sequence: Synthetic polypeptide
QLQLQESGPGLVKPSGTLSLTCAVSGGSISSSNWWSWVRQPPGKGLEWIGEIYHSGSTNYNPSLKSRVTISVDKSKNQFSLKLSSVTAADTAVYYCAGPGPDPNDAFDIWGQGTMVTVSS

SEQ ID NO: 794 - protein, 119 aa, Artificial Sequence
  Description of Artificial Sequence: Synthetic polypeptide
QVQLLESGGGLVQPGRSLRLSCAASGFTFDDYAMHWVRQAPGKGLEWVSGISWNSGSIGYADSVKGRFTISRDNAKNSLYLQMNSLRAEDTAVYYCARDLVYYYGMDVWGQGTTVTVSS

SEQ ID NO: 795 - protein, 118 aa, Artificial Sequence
  Description of Artificial Sequence: Synthetic polypeptide
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARSRRPYWYFDLWGQGTLVTVSS

SEQ ID NO: 796 - protein, 120 aa, Artificial Sequence
  Description of Artificial Sequence: Synthetic polypeptide
QMQLVQSGGGVVQPGRSLRLSCAASGFTFSSYAMHWVRQAPGKGLEWVAVISYDGSNKYYADSVKGRFTISRDNSKNTLYLQMNSLRAEDTAVYYCARDALWDTATFDYWGQGTLVTVSS

SEQ ID NO: 797 - protein, 121 aa, Artificial Sequence
  Description of Artificial Sequence: Synthetic polypeptide
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARSPLWFGPPDAFDIWGQGTMVTVSS

SEQ ID NO: 798 - protein, 122 aa, Artificial Sequence
  Description of Artificial Sequence: Synthetic polypeptide
QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARDSSSWYYYYGMDVWGQGTTVTVSS

SEQ ID NO: 799 - protein, 119 aa, Artificial Sequence
  Description of Artificial Sequence: Synthetic polypeptide
QVQLVQSGGGVVQPGRSLRLSCAASGFTFSSYAMHWVRQAPGKGLEWVAVISYDGSNKYYADSVKGRFTISRDNSKNTLYLQMNSLRAEDTAVYYCARDLSYDYGFDYWGQGTLVTVSS

SEQ ID NO: 800 - protein, 119 aa, Artificial Sequence
  Description of Artificial Sequence: Synthetic polypeptide
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCAISRTESYVMDVWGQGTTVTVSS

SEQ ID NO: 801 - protein, 122 aa, Artificial Sequence
  Description of Artificial Sequence: Synthetic polypeptide
QVQLLESGGGVVQPGRSLRLSCAASGFTFSSYGMHWVRQAPGKGLEWVAVISYDGSNKYYADSVKGRFTISRDNSKNTLYLQMNSLRAEDTAVYYCAKGAYYYGSVSGMDVWGQGTTVTVSS

SEQ ID NO: 802 - protein, 121 aa, Artificial Sequence
  Description of Artificial Sequence: Synthetic polypeptide
EVQLVQSGAEVKKPGASVKVSCKASGYTFTGYYMHWVRQAPGQGLEWMGWINPNSGGTNYAQKFQGWVTMTRDTSISTAYMELSRLRSDDTAVYYCARDPGWSYYYGMDVWGQGTTVTVSS

SEQ ID NO: 803 - protein, 116 aa, Artificial Sequence
  Description of Artificial Sequence: Synthetic polypeptide
EVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDGYGFDYWGQGTLVTVSS

SEQ ID NO: 804 - protein, 124 aa, Artificial Sequence
  Description of Artificial Sequence: Synthetic polypeptide
QVQLVQSGAEVKKPGESLKISCKGSGYSFTSYWIGWVRQMPGKGLEWMGIIYPGESDTRYSPSFQGQVTISADKSISTAYLQWSSLKASDTAMYYCARRNYYDRSGYVDAFDIWGQGTMVTVSS

SEQ ID NO: 805 - protein, 118 aa, Artificial Sequence
  Description of Artificial Sequence: Synthetic polypeptide
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARVARGKGAFDIWGQGTMVTVSS

SEQ ID NO: 806 - protein, 117 aa, Artificial Sequence
  Description of Artificial Sequence: Synthetic polypeptide
QMQLVQSGAEVKKPGASVKVSCKASGYTFTSYGISWVRQAPGQGLEWMGWINPNTGGTDYAQKFQGRVTITRDTSITTGYMELSRLRSDDTAVYYCARHYYYGMDVWGQGTTVTVSS

SEQ ID NO: 807 - protein, 119 aa, Artificial Sequence
  Description of Artificial Sequence: Synthetic polypeptide
QVQLVQSGGGVVQPGRSLRLSCAASGFTFSSYAMHWVRQAPGKGLEWVAVISYDGSNKYYADSVKGRFTISRDNAKNSLYLQMNSLRDEDTAVYYCARDESFDYGVDVWGKGTTVTVSS

SEQ ID NO: 808 - protein, 119 aa, Artificial Sequence; identical to SEQ ID NO: 807
  Description of Artificial Sequence: Synthetic polypeptide

SEQ ID NO: 809 - protein, 123 aa, Artificial Sequence
  Description of Artificial Sequence: Synthetic polypeptide
EVQLVQSGAEVKKPGASVKVSCKASGYTFTGYYMHWVRQAPGQGLEWMGWINPNSGGTNYAQKFQGWVTMTRDTSISTAYMELSRLRSDDTAVYYCARAGGWYRESSDAFDIWGQGTMVTVSS

SEQ ID NO: 810 - protein, 119 aa, Artificial Sequence
  Description of Artificial Sequence: Synthetic polypeptide
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARGGYRSYWYFDLWGRGTLVTVSS

SEQ ID NO: 811 - protein, 118 aa, Artificial Sequence
  Description of Artificial Sequence: Synthetic polypeptide
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARVSRSRGAFDIWGQGTMVTVSS

SEQ ID NO: 812 - protein, 118 aa, Artificial Sequence; identical to SEQ ID NO: 811
  Description of Artificial Sequence: Synthetic polypeptide

SEQ ID NO: 813 - protein, 127 aa, Artificial Sequence; identical to SEQ ID NO: 786
  Description of Artificial Sequence: Synthetic polypeptide

SEQ ID NO: 814 - protein, 119 aa, Artificial Sequence
  Description of Artificial Sequence: Synthetic polypeptide
EVQLVQSGGALVEPGGSLRLSCAASGFTFSSYAMHWVRQAPGKGLEWVAVISYDGSNKYYADSVKGRFTISRDNSKNTLYLQMNSLRAEDTAVYYCARDSTQDYGMDVWGQGTTVTVSS

SEQ ID NO: 815 - protein, 118 aa, Artificial Sequence; identical to SEQ ID NO: 805
  Description of Artificial Sequence: Synthetic polypeptide

SEQ ID NO: 816 - protein, 118 aa, Artificial Sequence; identical to SEQ ID NO: 811
  Description of Artificial Sequence: Synthetic polypeptide

SEQ ID NO: 817 - protein, 119 aa, Artificial Sequence
  Description of Artificial Sequence: Synthetic polypeptide
QMQLVQSGAEVKKPGASVKVSCKASGYTFTSYYMHWVRQAPGQGLEWMGIINPSGGSTSYAQKFQGRVTMTRDTSTSTAYMELRSLRSDDTAVYYCARGWETNDAFDIWGQGTMVTVSS

SEQ ID NO: 818 - protein, 127 aa, Artificial Sequence
  Description of Artificial Sequence: Synthetic polypeptide
EVQLLESGAEVKKPGASVKVSCKASGYTFTGYYMNWVRQAPGQGLEWMAWINPNTGDTNYAQKFQGRVTMTRDTSINTAYIELSRLTSDDTAVYYCARVGDYYDRSGYYRHDAFDIWGQGTMVTVSS

SEQ ID NO: 819 - protein, 127 aa, Artificial Sequence
  Description of Artificial Sequence: Synthetic polypeptide
EVQLVQSGAEVKKPGASVKVSCKASGYTFTGYYMNWVRQAPGQGLEWMAWINPNTGDTNYAQKFQGRVTMTRDTSINTAYIELSRLTSDDTAVYYCARVGDYYDRSGYYRHDAFDIWGQGTMVTVSS

SEQ ID NO: 820 - protein, 119 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDSTQDYGMDVWGQGTMVTVSS

SEQ ID NO: 821 - protein, 116 aa, Artificial Sequence
  Description of Artificial Sequence: Synthetic polypeptide
EVQLLESGGGVVQPGRSLRLSCAASGFTFSSYGMHWVRQAPGKGLEWVAVISYDGSNKYYADSVKGRFTISRDNSKNTLYLQMNSLRAEDTAVYYCAKGELELTNWGQGTLVTVSS

SEQ ID NO: 822 - protein, 119 aa, Artificial Sequence
  Description of Artificial Sequence: Synthetic polypeptide
EVQLLESGGGVVQPGRSLRLSCAASGFTFSSYAMHWVRQAPGKGLEWVAVISYDGSNKYYADSVKGRFTISRDNSKNTLYLQMNSLRAEDTAVYYCARDSTQDYGMDVWGQGTTVTVSS

SEQ ID NO: 823 - protein, 123 aa, Artificial Sequence
  Description of Artificial Sequence: Synthetic polypeptide
QVQLLESGGGLVQPGRSLRLSCAASGFTFDDYAMHWVRQAPGKGLEWVSGITWNSGSIGYADSVKGRFTISRDNAKNSLYLQMNSLRAEDTAVYYCAREVAARPFYYYGMDVWGQGTTVTVSS

SEQ ID NO: 824 - protein, 120 aa, Artificial Sequence
  Description of Artificial Sequence: Synthetic polypeptide
QVQLQQSGPGLVKASETLSLTCAVSGHSISSSNYWGWIRQPPGKGLEWIGSIYHSGTTYYNPSLKSRVTMSVDTSKNQFSLKLSSVTAADTAVYYCARHGSGDLGYLEYWGQGTLVTVSS

SEQ ID NO: 825 - protein, 126 aa, Artificial Sequence
  Description of Artificial Sequence: Synthetic polypeptide
QVQLLESGGGVVQPGRSLRLSCAASGFTFSSYAMHWVRQAPGKGLEWVAVISYDGSNKYYADSVKGRFTISRDNSKNTLYLQMNSLRAEDTAVYYCARGLGFGSGWYEYVDAFDIWGQGTMVTVSS

SEQ ID NO: 826 - protein, 119 aa, Artificial Sequence
  Description of Artificial Sequence: Synthetic polypeptide
QVQLVQSGGGVVQPGRSLRLSCAASGFTFSSYAMHWVRQAPGKGLEWVAVISYDGSNKYYADSVKGRFTISRDNSKNTLYLQMNSLRAEDTAVYYCARDGSEDYGMDVWGQGTTVTVSS

SEQ ID NO: 827 - protein, 121 aa, Artificial Sequence
  Description of Artificial Sequence: Synthetic polypeptide
QVQLVQSGGGLVQPGGSLRLSCAASGFTFSSYAMSWVRQAPGKGLEWVSAISGSGGSTYYADSVKGRFTISRDNSKNTLYLQMNSLRAEDTAVYYCAKDGYSYGGTSFDYWGQGTLVTVSS

SEQ ID NO: 828 - protein, 123 aa, Artificial Sequence
  Description of Artificial Sequence: Synthetic polypeptide
EVQLVESGGGVVQPGRSLRLSCAASGFTFSNYAMHWVRQAPGKGLEWVAIISYDGTNKYYADSVKGRFTISRDNAKNSLYLQMNSLRDEDTAVYYCARDPAYGSYYYYGMDVWGQGTTVTVSS

SEQ ID NO: 829 - protein, 123 aa, Artificial Sequence
  Description of Artificial Sequence: Synthetic polypeptide
QVQLVQSGGGVVQPGRSLRLSCAASGFTFSSYAMHWVRQAPGKGLEWVAVISYDGSNKYYADSVKGRFTISRDNSKNTLYLQMNSLRAEDTAVYYCARDSSGYYYGSDAFDIWGQGTMVTVSS

SEQ ID NO: 830 - protein, 119 aa, Artificial Sequence; identical to SEQ ID NO: 826
  Description of Artificial Sequence: Synthetic polypeptide

SEQ ID NO: 831 - protein, 127 aa, Artificial Sequence; identical to SEQ ID NO: 786
  Description of Artificial Sequence: Synthetic polypeptide

SEQ ID NO: 832 - protein, 127 aa, Artificial Sequence; identical to SEQ ID NO: 786
  Description of Artificial Sequence: Synthetic polypeptide

SEQ ID NO: 833 - protein, 118 aa, Artificial Sequence; identical to SEQ ID NO: 788
  Description of Artificial Sequence: Synthetic polypeptide

SEQ ID NO: 834 - protein, 118 aa, Artificial Sequence; identical to SEQ ID NO: 811
  Description of Artificial Sequence: Synthetic polypeptide

SEQ ID NO: 835 - protein, 124 aa, Artificial Sequence
  Description of Artificial Sequence: Synthetic polypeptide
QMQLVQSGGGLVQPGRSLRLSCAASGFTFDDYAMHWVRQAPGKGLEWVAVISYDGSNKYYADSVKGRFTISRDNSKNTLYLQMNSLRAEDTAVYYCARSSYDFWSGYPKDMDVWGKGTTVTVSS

SEQ ID NO: 836 - protein, 10 aa, Artificial Sequence
  Description of Artificial Sequence: Synthetic peptide
GYTFTSYYMH

SEQ ID NO: 837 - protein, 10 aa, Artificial Sequence
  Description of Artificial Sequence: Synthetic peptide
GFTFSSYAMH

SEQ ID NO: 838 - protein, 10 aa, Artificial Sequence
  Description of Artificial Sequence: Synthetic peptide
GGTFSSYAIS

SEQ ID NO: 839 - protein, 10 aa, Artificial Sequence
  Description of Artificial Sequence: Synthetic peptide
GYTFTGYYMN

SEQ ID NO: 840 - protein, 10 aa, Artificial Sequence
  Description of Artificial Sequence: Synthetic peptide
GGTFSSYAIS

SEQ ID NO: 841 - protein, 10 aa, Artificial Sequence
  Description of Artificial Sequence: Synthetic peptide
GGSFSGYYWS

SEQ ID NO: 842 - protein, 10 aa, Artificial Sequence
  Description of Artificial Sequence: Synthetic peptide
GFTFSSYAMH

SEQ ID NO: 843 - protein, 10 aa, Artificial Sequence
  Description of Artificial Sequence: Synthetic peptide
GGSFSGYYWS

SEQ ID NO: 844 - protein, 10 aa, Artificial Sequence
  Description of Artificial Sequence: Synthetic peptide
GGSFSGYYWS

SEQ ID NO: 845 - protein, 10 aa, Artificial Sequence
  Description of Artificial Sequence: Synthetic peptide
GFTFSSYGMH

SEQ ID NO: 846 - protein, 11 aa, Artificial Sequence
  Description of Artificial Sequence: Synthetic peptide
GGSISSSNWWS

SEQ ID NO: 847 - protein, 10 aa, Artificial Sequence
  Description of Artificial Sequence: Synthetic peptide
GFTFDDYAMH

SEQ ID NO: 848 - protein, 10 aa, Artificial Sequence
  Description of Artificial Sequence: Synthetic peptide
GGSFSGYYWS

SEQ ID NO: 849 - protein, 10 aa, Artificial Sequence
  Description of Artificial Sequence: Synthetic peptide
GFTFSSYAMH

SEQ ID NO: 850 - protein, 10 aa, Artificial Sequence
  Description of Artificial Sequence: Synthetic peptide
GGSFSGYYWS

SEQ ID NO: 851 - protein, 10 aa, Artificial Sequence
  Description of Artificial Sequence: Synthetic peptide
GYTFTSYGIS

SEQ ID NO: 852 - protein, 10 aa, Artificial Sequence
  Description of Artificial Sequence: Synthetic peptide
GFTFSSYAMH

SEQ ID NO: 853 - protein, 10 aa, Artificial Sequence
  Description of Artificial Sequence: Synthetic peptide
GYSFTSYWIG

SEQ ID NO: 854 - protein, 10 aa, Artificial Sequence
  Description of Artificial Sequence: Synthetic peptide
GFTFSSYGMH

SEQ ID NO: 855 - protein, 10 aa, Artificial Sequence
  Description of Artificial Sequence: Synthetic peptide
GYTFTGYYMH

SEQ ID NO: 856 - protein, 10 aa, Artificial Sequence
  Description of Artificial Sequence: Synthetic peptide
GFTFSSYAMH

SEQ ID NO: 857 - protein, 10 aa, Artificial Sequence
  Description of Artificial Sequence: Synthetic peptide
GYSFTSYWIG

SEQ ID NO: 858 - protein, 10 aa, Artificial Sequence
  Description of Artificial Sequence: Synthetic peptide
GGSFSGYYWS

SEQ ID NO: 859 - protein, 10 aa, Artificial Sequence
  Description of Artificial Sequence: Synthetic peptide
GYTFTSYGIS

SEQ ID NO: 860 - protein, 10 aa, Artificial Sequence
  Description of Artificial Sequence: Synthetic peptide
GFTFSSYAMH

SEQ ID NO: 861 - protein, 10 aa, Artificial Sequence
  Description of Artificial Sequence: Synthetic peptide
GFTFSSYAMH

SEQ ID NO: 862 - protein, 10 aa, Artificial Sequence
  Description of Artificial Sequence: Synthetic peptide
GYTFTGYYMH

SEQ ID NO: 863 - protein, 10 aa, Artificial Sequence
  Description of Artificial Sequence: Synthetic peptide
GGSFSGYYWS

SEQ ID NO: 864 - protein, 10 aa, Artificial Sequence
  Description of Artificial Sequence: Synthetic peptide
GGSFSGYYWS

SEQ ID NO: 865 - protein, 10 aa, Artificial Sequence
  Description of Artificial Sequence: Synthetic peptide
GGSFSGYYWS

SEQ ID NO: 866 - protein, 10 aa, Artificial Sequence
  Description of Artificial Sequence: Synthetic peptide
GYTFTGYYMN

SEQ ID NO: 867 - protein, 10 aa, Artificial Sequence
  Description of Artificial Sequence: Synthetic peptide
GFTFSSYAMH

SEQ ID NO: 868 - protein, 10 aa, Artificial Sequence
  Description of Artificial Sequence: Synthetic peptide
GGSFSGYYWS

SEQ ID NO: 869 - protein, 10 aa, Artificial Sequence
  Description of Artificial Sequence: Synthetic peptide
GGSFSGYYWS

SEQ ID NO: 870 - protein, 10 aa, Artificial Sequence
  Description of Artificial Sequence: Synthetic peptide
GYTFTSYYMH

SEQ ID NO: 871 - protein, 10 aa, Artificial Sequence
  Description of Artificial Sequence: Synthetic peptide
GYTFTGYYMN

SEQ ID NO: 872 - protein, 10 aa, Artificial Sequence
  Description of Artificial Sequence: Synthetic peptide
GYTFTGYYMN

SEQ ID NO: 873 - protein, 10 aa, Artificial Sequence
  Description of Artificial Sequence: Synthetic peptide
GFTFSSYAMH

SEQ ID NO: 874 - protein, 10 aa, Artificial Sequence
  Description of Artificial Sequence: Synthetic peptide
GFTFSSYGMH

SEQ ID NO: 875 - protein, 10 aa, Artificial Sequence
  Description of Artificial Sequence: Synthetic peptide
GFTFSSYAMH

SEQ ID NO: 876 - protein, 10 aa, Artificial Sequence
  Description of Artificial Sequence: Synthetic peptide
GFTFDDYAMH

SEQ ID NO: 877 - protein, 11 aa, Artificial Sequence
  Description of Artificial Sequence: Synthetic peptide
GHSISSSNYWG

SEQ ID NO: 878 - protein, 10 aa, Artificial Sequence
  Description of Artificial Sequence: Synthetic peptide
GFTFSSYAMH

SEQ ID NO: 879 - protein, 10 aa, Artificial Sequence
  Description of Artificial Sequence: Synthetic peptide
GFTFSSYAMH

SEQ ID NO: 880 - protein, 10 aa, Artificial Sequence
  Description of Artificial Sequence: Synthetic peptide
GFTFSSYAMS

SEQ ID NO: 881 - protein, 10 aa, Artificial Sequence
  Description of Artificial Sequence: Synthetic peptide
GFTFSNYAMH

SEQ ID NO: 882 - protein, 10 aa, Artificial Sequence
  Description of Artificial Sequence: Synthetic peptide
GFTFSSYAMH

SEQ ID NO: 883 - protein, 10 aa, Artificial Sequence
  Description of Artificial Sequence: Synthetic peptide
GFTFSSYAMH

SEQ ID NO: 884 - protein, 10 aa, Artificial Sequence
  Description of Artificial Sequence: Synthetic peptide
GYTFTGYYMN

SEQ ID NO: 885 - protein, 10 aa, Artificial Sequence
  Description of Artificial Sequence: Synthetic peptide
GYTFTGYYMN

SEQ ID NO: 886 - protein, 10 aa, Artificial Sequence
  Description of Artificial Sequence: Synthetic peptide
GGSFSGYYWS

SEQ ID NO: 887 - protein, 10 aa, Artificial Sequence
  Description of Artificial Sequence: Synthetic peptide
GGSFSGYYWS

SEQ ID NO: 888 - protein, 10 aa, Artificial Sequence
  Description of Artificial Sequence: Synthetic peptide
GFTFDDYAMH

SEQ ID NO: 889 - protein, 15 aa, Artificial Sequence
  Description of Artificial Sequence: Synthetic peptide
GIINPSGGSTSYAQK

SEQ ID NO: 890 - protein, 15 aa, Artificial Sequence
  Description of Artificial Sequence: Synthetic peptide
AVISYDGSNKYYADS

SEQ ID NO: 891 - protein, 15 aa, Artificial Sequence
  Description of Artificial Sequence: Synthetic peptide
GWISAYNGNTNYAQK

SEQ ID NO: 892 - protein, 15 aa, Artificial Sequence
  Description of Artificial Sequence: Synthetic peptide
AWINPNTGDTNYAQK

SEQ ID NO: 893 - protein, 15 aa, Artificial Sequence
  Description of Artificial Sequence: Synthetic peptide
GWISAYNGNTNYAQK

SEQ ID NO: 894 - protein, 14 aa, Artificial Sequence
  Description of Artificial Sequence: Synthetic peptide
GEINHSGSTNYNPS

SEQ ID NO: 895 - protein, 15 aa, Artificial Sequence
  Description of Artificial Sequence: Synthetic peptide
AVISYDGSNKYYADS

SEQ ID NO: 896 - protein, 14 aa, Artificial Sequence
  Description of Artificial Sequence: Synthetic peptide
GEINHSGSTNYNPS

SEQ ID NO: 897 - protein, 14 aa, Artificial Sequence
  Description of Artificial Sequence: Synthetic peptide
GEINHSGSTNYNPS

SEQ ID NO: 898 - protein, 15 aa, Artificial Sequence
  Description of Artificial Sequence: Synthetic peptide
AVISYDGSNKYYADS

SEQ ID NO: 899 - protein, 14 aa, Artificial Sequence
  Description of Artificial Sequence: Synthetic peptide
GEIYHSGSTNYNPS

SEQ ID NO: 900 - protein, 15 aa, Artificial Sequence
  Description of Artificial Sequence: Synthetic peptide
SGISWNSGSIGYADS

SEQ ID NO: 901 - protein, 14 aa, Artificial Sequence
  Description of Artificial Sequence: Synthetic peptide
GEINHSGSTNYNPS

SEQ ID NO: 902 - protein, 15 aa, Artificial Sequence
  Description of Artificial Sequence: Synthetic peptide
AVISYDGSNKYYADS

SEQ ID NO: 903 - protein, 14 aa, Artificial Sequence
  Description of Artificial Sequence: Synthetic peptide
GEINHSGSTNYNPS

SEQ ID NO: 904 - protein, 15 aa, Artificial Sequence
  Description of Artificial Sequence: Synthetic peptide
GWISAYNGNTNYAQK

SEQ ID NO: 905 - protein, 15 aa, Artificial Sequence
  Description of Artificial Sequence: Synthetic peptide
AVISYDGSNKYYADS

SEQ ID NO: 906 - protein, 15 aa, Artificial Sequence
  Description of Artificial Sequence: Synthetic peptide
GIIYPGDSDTRYSPS

SEQ ID NO: 907 - protein, 15 aa, Artificial Sequence
  Description of Artificial Sequence: Synthetic peptide
AVISYDGSNKYYADS

SEQ ID NO: 908 - protein, 15 aa, Artificial Sequence
  Description of Artificial Sequence: Synthetic peptide
GWINPNSGGTNYAQK

SEQ ID NO: 909 - protein, 15 aa, Artificial Sequence
  Description of Artificial Sequence: Synthetic peptide
AVISYDGSNKYYADS

SEQ ID NO: 910 - protein, 15 aa, Artificial Sequence
  Description of Artificial Sequence: Synthetic peptide
GIIYPGESDTRYSPS

SEQ ID NO: 911 - protein, 14 aa, Artificial Sequence
  Description of Artificial Sequence: Synthetic peptide
GEINHSGSTNYNPS

SEQ ID NO: 912 - protein, 15 aa, Artificial Sequence
  Description of Artificial Sequence: Synthetic peptide
GWINPNTGGTDYAQK

SEQ ID NO: 913 - protein, 15 aa, Artificial Sequence
  Description of Artificial Sequence: Synthetic peptide
AVISYDGSNKYYADS

SEQ ID NO: 914 - protein, 15 aa, Artificial Sequence
  Description of Artificial Sequence: Synthetic peptide
AVISYDGSNKYYADS

SEQ ID NO: 915 - protein, 15 aa, Artificial Sequence
  Description of Artificial Sequence: Synthetic peptide
GWINPNSGGTNYAQK

SEQ ID NO: 916 - protein, 14 aa, Artificial Sequence
  Description of Artificial Sequence: Synthetic peptide
GEINHSGSTNYNPS

SEQ ID NO: 917 - protein, 14 aa, Artificial Sequence
  Description of Artificial Sequence: Synthetic peptide
GEINHSGSTNYNPS

SEQ ID NO: 918 - protein, 14 aa, Artificial Sequence
  Description of Artificial Sequence: Synthetic peptide
GEINHSGSTNYNPS

SEQ ID NO: 919 - protein, 15 aa, Artificial Sequence
  Description of Artificial Sequence: Synthetic peptide
AWINPNTGDTNYAQK

SEQ ID NO: 920 - protein, 15 aa, Artificial Sequence
  Description of Artificial Sequence: Synthetic peptide
AVISYDGSNKYYADS

SEQ ID NO: 921 - protein, 14 aa, Artificial Sequence
  Description of Artificial Sequence: Synthetic peptide
GEINHSGSTNYNPS

SEQ ID NO: 922 - protein, 14 aa, Artificial Sequence
  Description of Artificial Sequence: Synthetic peptide
GEINHSGSTNYNPS

SEQ ID NO: 923 - protein, 15 aa, Artificial Sequence
  Description of Artificial Sequence: Synthetic peptide
GIINPSGGSTSYAQK

SEQ ID NO: 924 - protein, 15 aa, Artificial Sequence
  Description of Artificial Sequence: Synthetic peptide
AWINPNTGDTNYAQK

SEQ ID NO: 925 - protein, 15 aa, Artificial Sequence
  Description of Artificial Sequence: Synthetic peptide
AWINPNTGDTNYAQK

SEQ ID NO: 926 - protein, 15 aa, Artificial Sequence
  Description of Artificial Sequence: Synthetic peptide
AVISYDGSNKYYADS

SEQ ID NO: 927 - protein, 15 aa, Artificial Sequence
  Description of Artificial Sequence: Synthetic peptide
AVISYDGSNKYYADS

SEQ ID NO: 928 - protein, 15 aa, Artificial Sequence
  Description of Artificial Sequence: Synthetic peptide
AVISYDGSNKYYADS

SEQ ID NO: 929 - protein, 15 aa, Artificial Sequence
  Description of Artificial Sequence: Synthetic peptide
SGITWNSGSIGYADS

SEQ ID NO: 930 - protein, 14 aa, Artificial Sequence
  Description of Artificial Sequence: Synthetic peptide
GSIYHSGTTYYNPS

SEQ ID NO: 931 - protein, 15 aa, Artificial Sequence
  Description of Artificial Sequence: Synthetic peptide
AVISYDGSNKYYADS

SEQ ID NO: 932 - protein, 15 aa, Artificial Sequence
  Description of Artificial Sequence: Synthetic peptide
AVISYDGSNKYYADS

SEQ ID NO: 933 - protein, 15 aa, Artificial Sequence
  Description of Artificial Sequence: Synthetic peptide
SAISGSGGSTYYADS

SEQ ID NO: 934 - protein, 15 aa, Artificial Sequence
  Description of Artificial Sequence: Synthetic peptide
AIISYDGTNKYYADS

SEQ ID NO: 935 - protein, 15 aa, Artificial Sequence
  Description of Artificial Sequence: Synthetic peptide
AVISYDGSNKYYADS

SEQ ID NO: 936 - protein, 15 aa, Artificial Sequence
  Description of Artificial Sequence: Synthetic peptide
AVISYDGSNKYYADS

SEQ ID NO: 937 - protein, 15 aa, Artificial Sequence
  Description of Artificial Sequence: Synthetic peptide
AWINPNTGDTNYAQK

SEQ ID NO: 938 - protein, 15 aa, Artificial Sequence
  Description of Artificial Sequence: Synthetic peptide
AWINPNTGDTNYAQK

SEQ ID NO: 939 - protein, 14 aa, Artificial Sequence
  Description of Artificial Sequence: Synthetic peptide
GEINHSGSTNYNPS

SEQ ID NO: 940 - protein, 14 aa, Artificial Sequence
  Description of Artificial Sequence: Synthetic peptide
GEINHSGSTNYNPS

SEQ ID NO: 941 - protein, 15 aa, Artificial Sequence
  Description of Artificial Sequence: Synthetic peptide
AVISYDGSNKYYADS

SEQ ID NO: 942 - protein, 19 aa, Artificial Sequence
  Description of Artificial Sequence: Synthetic peptide
AIEPGYCSGGSCYPDAFDI

SEQ ID NO: 943 - protein, 13 aa, Artificial Sequence
  Description of Artificial Sequence: Synthetic peptide
ARDGHPYYYGMDV

SEQ ID NO: 944 - protein, 14 aa, Artificial Sequence
  Description of Artificial Sequence: Synthetic peptide
ARVTPPGWLGNMDV

SEQ ID NO: 945 - protein, 20 aa, Artificial Sequence
  Description of Artificial Sequence: Synthetic peptide
ARVGDYYDRSGYYRHDAFDI

SEQ ID NO: 946 - protein, 5 aa, Artificial Sequence
  Description of Artificial Sequence: Synthetic peptide
ARDDY

SEQ ID NO: 947 - protein, 12 aa, Artificial Sequence
  Description of Artificial Sequence: Synthetic peptide
ARSRRPYWYFDL

SEQ ID NO: 948 - protein, 16 aa, Artificial Sequence
  Description of Artificial Sequence: Synthetic peptide
ATNSGYDSDYYYGMDV

SEQ ID NO: 949 - protein, 12 aa, Artificial Sequence
  Description of Artificial Sequence: Synthetic peptide
ARSRRPYWYFDL

SEQ ID NO: 950 - protein, 12 aa, Artificial Sequence
  Description of Artificial Sequence: Synthetic peptide
ARSRRPYWYFDL

SEQ ID NO: 951 - protein, 15 aa, Artificial Sequence
  Description of Artificial Sequence: Synthetic peptide
AKAGAPPHYYYGMDV

SEQ ID NO: 952 - protein, 13 aa, Artificial Sequence
  Description of Artificial Sequence: Synthetic peptide
AGPGPDPNDAFDI

SEQ ID NO: 953 - protein, 12 aa, Artificial Sequence
  Description of Artificial Sequence: Synthetic peptide
ARDLVYYYGMDV

SEQ ID NO: 954 - protein, 12 aa, Artificial Sequence
  Description of Artificial Sequence: Synthetic peptide
ARSRRPYWYFDL

SEQ ID NO: 955 - protein, 13 aa, Artificial Sequence
  Description of Artificial Sequence: Synthetic peptide
ARDALWDTATFDY

SEQ ID NO: 956 - protein, 15 aa, Artificial Sequence
  Description of Artificial Sequence: Synthetic peptide
ARSPLWFGPPDAFDI

SEQ ID NO: 957 - protein, 15 aa, Artificial Sequence
  Description of Artificial Sequence: Synthetic peptide
ARDSSSWYYYYGMDV

SEQ ID NO: 958 - protein, 12 aa, Artificial Sequence
  Description of Artificial Sequence: Synthetic peptide
ARDLSYDYGFDY

SEQ ID NO: 959 - protein, 12 aa, Artificial Sequence
  Description of Artificial Sequence: Synthetic peptide
AISRTESYVMDV

SEQ ID NO: 960 - protein, 15 aa, Artificial Sequence
  Description of Artificial Sequence: Synthetic peptide
AKGAYYYGSVSGMDV

SEQ ID NO: 961 - protein, 14 aa, Artificial Sequence
  Description of Artificial Sequence: Synthetic peptide
ARDPGWSYYYGMDV

SEQ ID NO: 962 - protein, 9 aa, Artificial Sequence
  Description of Artificial Sequence: Synthetic peptide
ARDGYGFDY

SEQ ID NO: 963 - protein, 17 aa, Artificial Sequence
  Description of Artificial Sequence: Synthetic peptide
ARRNYYDRSGYVDAFDI

SEQ ID NO: 964 - protein, 12 aa, Artificial Sequence
  Description of Artificial Sequence: Synthetic peptide
ARVARGKGAFDI

SEQ ID NO: 965 - protein, 10 aa, Artificial Sequence
  Description of Artificial Sequence: Synthetic peptide
ARHYYYGMDV

SEQ ID NO: 966 - protein, 12 aa, Artificial Sequence
  Description of Artificial Sequence: Synthetic peptide
ARDESFDYGVDV

SEQ ID NO: 967 - protein, 12 aa, Artificial Sequence
  Description of Artificial Sequence: Synthetic peptide
ARDESFDYGVDV

SEQ ID NO: 968 - protein, 16 aa, Artificial Sequence
  Description of Artificial Sequence: Synthetic peptide
ARAGGWYRESSDAFDI

SEQ ID NO: 969 - protein, 13 aa, Artificial Sequence
  Description of Artificial Sequence: Synthetic peptide
ARGGYRSYWYFDL

SEQ ID NO: 970 - protein, 12 aa, Artificial Sequence
  Description of Artificial Sequence: Synthetic peptide
ARVSRSRGAFDI

SEQ ID NO: 971 - protein, 12 aa, Artificial Sequence
  Description of Artificial Sequence: Synthetic peptide
ARVSRSRGAFDI

SEQ ID NO: 972 - protein, 20 aa, Artificial Sequence
  Description of Artificial Sequence: Synthetic peptide
ARVGDYYDRSGYYRHDAFDI

SEQ ID NO: 973 - protein, 12 aa, Artificial Sequence
  Description of Artificial Sequence: Synthetic peptide
ARDSTQDYGMDV

SEQ ID NO: 974 - protein, 12 aa, Artificial Sequence
  Description of Artificial Sequence: Synthetic peptide
ARVARGKGAFDI

SEQ ID NO: 975 - protein, 12 aa, Artificial Sequence
  Description of Artificial Sequence: Synthetic peptide
ARVSRSRGAFDI

SEQ ID NO: 976 - protein, 12 aa, Artificial Sequence
  Description of Artificial Sequence: Synthetic peptide
ARGWETNDAFDI

SEQ ID NO: 977 - protein, 20 aa, Artificial Sequence
  Description of Artificial Sequence: Synthetic peptide
ARVGDYYDRSGYYRHDAFDI

SEQ ID NO: 978 - protein, 20 aa, Artificial Sequence
  Description of Artificial Sequence: Synthetic peptide
ARVGDYYDRSGYYRHDAFDI

SEQ ID NO: 979 - protein, 12 aa, Artificial Sequence
  Description of Artificial Sequence: Synthetic peptide
ARDSTQDYGMDV

SEQ ID NO: 980 - protein, 9 aa, Artificial Sequence
  Description of Artificial Sequence: Synthetic peptide
AKGELELTN

SEQ ID NO: 981 - protein, 12 aa, Artificial Sequence
  Description of Artificial Sequence: Synthetic peptide
ARDSTQDYGMDV

SEQ ID NO: 982 - protein, 16 aa, Artificial Sequence
  Description of Artificial Sequence: Synthetic peptide
AREVAARPFYYYGMDV

SEQ ID NO: 983 - protein, 13 aa, Artificial Sequence
  Description of Artificial Sequence: Synthetic peptide
ARHGSGDLGYLEY

SEQ ID NO: 984 - protein, 19 aa, Artificial Sequence
  Description of Artificial Sequence: Synthetic peptide
ARGLGFGSGWYEYVDAFDI

SEQ ID NO: 985 - protein, 12 aa, Artificial Sequence
  Description of Artificial Sequence: Synthetic peptide
ARDGSEDYGMDV

SEQ ID NO: 986 - protein, 14 aa, Artificial Sequence
  Description of Artificial Sequence: Synthetic peptide
AKDGYSYGGTSFDY

SEQ ID NO: 987 - protein, 16 aa, Artificial Sequence
  Description of Artificial Sequence: Synthetic peptide
ARDPAYGSYYYYGMDV

SEQ ID NO: 988 - protein, 16 aa, Artificial Sequence
  Description of Artificial Sequence: Synthetic peptide
ARDSSGYYYGSDAFDI

SEQ ID NO: 989 - protein, 12 aa, Artificial Sequence
  Description of Artificial Sequence: Synthetic peptide
ARDGSEDYGMDV

SEQ ID NO: 990 - protein, 20 aa, Artificial Sequence
  Description of Artificial Sequence: Synthetic peptide
ARVGDYYDRSGYYRHDAFDI

SEQ ID NO: 991 - protein, 20 aa, Artificial Sequence
  Description of Artificial Sequence: Synthetic peptide
ARVGDYYDRSGYYRHDAFDI

SEQ ID NO: 992 - protein, 12 aa, Artificial Sequence
  Description of Artificial Sequence: Synthetic peptide
ARSRRPYWYFDL

SEQ ID NO: 993 - protein, 12 aa, Artificial Sequence
  Description of Artificial Sequence: Synthetic peptide
ARVSRSRGAFDI

SEQ ID NO: 994 - protein, 17 aa, Artificial Sequence
  Description of Artificial Sequence: Synthetic peptide
ARSSYDFWSGYPKDMDV

SEQ ID NO: 995 - protein, 110 aa, Artificial Sequence
  Description of Artificial Sequence: Synthetic polypeptide
QSVLTQPPSASGTPGQRVTISCSGSSSNIGSDYVYWYQRVPGTAPKLLIYRDNQRPSGVPDRFSGSKSGTSASLAISGLRSDDEADYYCAAWDDSLSGWVFGGGTKVTVL

SEQ ID NO: 996 - protein, 110 aa, Artificial Sequence
  Description of Artificial Sequence: Synthetic polypeptide
QSALTQPASVSGSPGQSITISCTGTSSDVGDYNYVSWYQHHPGKAPKLMIYDVSNRPSGVSNRFSGSKSGNTASLTISGLQAEDEADYYCGSYTGSDTWVFGGGTKVTVL

SEQ ID NO: 997 - protein, 107 aa, Artificial Sequence
  Description of Artificial Sequence: Synthetic polypeptide
SYELMQSPSVSVAPGQTARITCGGRDIGSKSVHWYQQKPGQAPVLVVYDDSDRPSGIPERLSGSNFGNEATLTISRVEAGDEGDYFCQVWDSSTDVVFGGGTKVTVL

SEQ ID NO: 998 - protein, 107 aa, Artificial Sequence
  Description of Artificial Sequence: Synthetic polypeptide
SSELTQDPAVSVALGQTVRITCQGDSLRSYYASWYQQKPGQAPVLVIYGKNNRPSGIPDRFSGSSSGNTASLTITGAQAMDEADYYCQAWDSSTGVVFGGGTKVTVL

SEQ ID NO: 999 - protein, 106 aa, Artificial Sequence
  Description of Artificial Sequence: Synthetic polypeptide
SYELTQPPSVSVAPGKTARITCSGDVLGENYADWYQQKPGQAPELVIYEDSERYPGIPERFSGSTSGNTTTLTISRVLTEDEADYYCLSGDEDNRVFGGGTKLTVL

SEQ ID NO: 1000 - protein, 110 aa, Artificial Sequence
  Description of Artificial Sequence: Synthetic polypeptide
QSALTQPASVSGSPGQSITISCTGTSSDVGGYNSVSWYRQHPGKAPKLMIYDVTNRPSGVSNRFSGSKSGNTASLTISGLQAEDEADYYCSSSSISATWVFGGGTKVTVL

SEQ ID NO: 1001 - protein, 112 aa, Artificial Sequence
  Description of Artificial Sequence: Synthetic polypeptide
QSVLTQPPSMSGAPGQRVTISCTGSSSNIGAGYDVHWYQHLPGTGPKLLIHGNTNRPSGVPDRFSGSKSGTSASLAITGLQAEDEADYYCQSYDNSLGGYVVFGGGTKVTVL

SEQ ID NO: 1002 - protein, 110 aa, Artificial Sequence
  Description of Artificial Sequence: Synthetic polypeptide
QSALTQPASVSGSPGQSITISCTGTSSDVGGYNSVSWYRQHPGKAPKLMIYDVTNRPSGVSNRFSGSKSGNTASLTISGLQAEDEADYYCSSSSISATWVFGGGTKLTVL

SEQ ID NO: 1003 - protein, 112 aa, Artificial Sequence
  Description of Artificial Sequence: Synthetic polypeptide
QSALTQPPSASGSPGQSVTISCTGTSSDVGGYDSVSWYQQHPGKAPKLMIYDVSNRPSGVSNRFSGSKSGNTASLTISGLQAEDEADYYCSSYTSSTTLGWIFGGGTKLTVL

SEQ ID NO: 1004 - protein, 111 aa, Artificial Sequence
  Description of Artificial Sequence: Synthetic polypeptide
QSALTQPASVSGSPGQSITISCTGTSSDVGGYDYVSWYQQHPGKAPKLMIYEVTDRPSGIPNRFSGSKSGNTASLTISGLQAEDEADYYCSSYTYTSTLEVFGGGTKVTVL

SEQ ID NO: 1005 - protein, 106 aa, Artificial Sequence
  Description of Artificial Sequence: Synthetic polypeptide
SSELTQDPAVSVALGQTVRITCQGDSLRSYYASWYQQLPGTAPKLLIYQDSKRPSGIPERFSGSNSGNTATLTISGTQAMDEADYYCQAWDSSTAVFGGGTKLTVL

SEQ ID NO: 1006 - protein, 110 aa, Artificial Sequence
  Description of Artificial Sequence: Synthetic polypeptide
QSVLTQPPSVSGTPGQGVSISCSGSSSNIGWKTVNWYQQVPGMAPKLLIYSDNQRPSGVPDRFSGSKSATSASLAISGLQSEDEADYYCASWDASVNAPVFGGGTKLTVL

SEQ ID NO: 1007 - protein, 111 aa, Artificial Sequence
  Description of Artificial Sequence: Synthetic polypeptide
QSALTQPASVSGSPGQSITISCTGTSSDVGAYDSVSWYLQYPGKAPKLMIYDVTNRPSGVSNRFSGSKSGNTASLTISGLQAEDEAHYYCISYTASSTYVVFGGGTKLTVL

SEQ ID NO: 1008 - protein, 108 aa, Artificial Sequence
  Description of Artificial Sequence: Synthetic polypeptide
SSELTQDPAVSVALGQTVRITCQGDSLRSYYASWYQQKPGQAPVLVIYGKNNRPSGIPDRFSGSSSGNTASLTITGAQAEDEADYYCNSRDSSGNPWVFGGGTKLTVL

SEQ ID NO: 1009 - protein, 110 aa, Artificial Sequence
  Description of Artificial Sequence: Synthetic polypeptide
QSALTQPPSASGSPGQSVSISCTGTSSDVGGYNYVSWYQQHPGKAPKLIIYDVDKRPSGIPERFSGSNSGNTATLTISGTQAMDEADYYCQAWDSSTEVVFGGGTKVTVL

SEQ ID NO: 1010 - protein, 108 aa, Artificial Sequence
  Description of Artificial Sequence: Synthetic polypeptide
SYELTQPPSVSVSPGQTARISCSGDALPNQYAYWYQQKPGQAPVLVIYQDSERPSGIPERFSGSSSGTTVTLTISGVQAEDEADYYCQSADTYGTSWVFGGGTKLTVL

SEQ ID NO: 1011 - protein, 109 aa, Artificial Sequence
  Description of Artificial Sequence: Synthetic polypeptide
SSELTQDPAVSVALGQTVRITCQGDSLRSYYASWYQQKPGQAPVLVIYGKNNRPSGIPDRFSGSSSGNTASLTITGAQAEDEADYYCNSRDSSGNHLVVFGGGTKVTVL

SEQ ID NO: 1012 - protein, 109 aa, Artificial Sequence
  Description of Artificial Sequence: Synthetic polypeptide
QSALTQPRSVSGSPGQSVTISCTGTSSDVGGYNYVSWYQQHPGKAPKLMIYDVTNRPSGVPDRFSASKSDNTATLTVSGVQAEDEADYYCSSYAGSHELFGGGTKLTVL

SEQ ID NO: 1013 - protein, 108 aa, Artificial Sequence
  Description of Artificial Sequence: Synthetic polypeptide
SYELTQPVSVSVALGQTARLTCAGNNIGSKNVHWYQQKPSQAPVLVIYNDNIRPNFGIPERFSGSNSGNTATLTISSAQAGDEADYYCQVWDSSTAEVFGGGTKLTVL

SEQ ID NO: 1014 - protein, 111 aa, Artificial Sequence
  Description of Artificial Sequence: Synthetic polypeptide
QSALTQPRSVSGSPGQSVTISCTGTSSDVGGYNYVSWYQQHPGKAPQLMIFEVSYRPSGVPDRFSGSKSGTSASLAISGLQSEDEADYYCAAWDDSLKGYVFGTGTKLTVL

SEQ ID NO: 1015 - protein, 107 aa, Artificial Sequence
  Description of Artificial Sequence: Synthetic polypeptide
SYELTQSPSVSVAPGQTARITCGGNNIGSKSVHWYQQKPGQAPVLVVYDDSDRPSGIPERFSGSNSGNTATLTISRVEAGDEADYYCQVWDSSTPYVFGTGTKLTVL

SEQ ID NO: 1016 - protein, 108 aa, Artificial Sequence
  Description of Artificial Sequence: Synthetic polypeptide
SSELTQDPAVSVALGQTVRITCQGDSLRRFYASWHQQKPGQAPIVVMYAENNRPSGIPDRFSGSSSGNTASLTITGAQAEDEATYYCNSRDSSGNRHVFGTGTKLTVL

SEQ ID NO: 1017 - protein, 110 aa, Artificial Sequence
  Description of Artificial Sequence: Synthetic polypeptide
QSALTQPASVSGSPGQSITISCTGTSSDIGGYNFVSWYQQHPGKAPKLMIYEVSNRPSGVSNRFSGSKSGNTASLTISGLQAEDEADYYCSSYTSSSAWVFGGGTKLTVL

SEQ ID NO: 1018 - protein, 107 aa, Artificial Sequence
  Description of Artificial Sequence: Synthetic polypeptide
DIQLTQSPSSLSASVGDRVTITCQASQDISNYLNWYQQKPGKAPKLLIYDASNLETGVPSRFSGSGSGTDFTFTISSLQPEDIATYYCQQYDNLPLTFGGGTKVEIK

SEQ ID NO: 1019 - protein, 109 aa, Artificial Sequence
  Description of Artificial Sequence: Synthetic polypeptide
SSELTQDPAVSVALGQTVRITCQGDSLGRFYASWYQQKPGQAPVLVIYGKNNRPSGIPDRFSGSSSGNTASLTITGAQAEDEADYYCNSRDSSGNHLVVFGGGTKLTVL

SEQ ID NO: 1020 - protein, 109 aa, Artificial Sequence
  Description of Artificial Sequence: Synthetic polypeptide
SSELTQDPAVSVALGQTVRITCQGDSLRSYYASWYQQKPGQAPVLVIYGKNNRPSGIPDRFSGSSSGNTASLTITGAQAEDEADYYCNSRDSSGNHLVVFGGGTKLTVL

SEQ ID NO: 1021 - protein, 110 aa, Artificial Sequence
  Description of Artificial Sequence: Synthetic polypeptide
SYELTQPPSASGTPGQRVTISCSGSSSNIGSNYVYWYQQLPGTAPKLLIYRNNQRPSGVPDRFSGSKSGTSASLAISGLRSEDEADYYCAAWDDSLSGYVFGTGIKVTVL

SEQ ID NO: 1022 - protein, 110 aa, Artificial Sequence
  Description of Artificial Sequence: Synthetic polypeptide
QSALTQPASVSGSPGQSITISCTGTSSDVGGYNSVSWYQHHPGKAPKLMIYDVSDRPSGVSDRFSGSKSGNTASLTISGLQAEDEADYYCSSYAGSNNVVFGGGTKVTVL

SEQ ID NO: 1023 - protein, 110 aa, Artificial Sequence
  Description of Artificial Sequence: Synthetic polypeptide
QSALTQPASVSGSPGQSLTISCTGTSSDVGVYNYVSWYQQHPGKAPKLMIYDVGIRPSGVSNRFSGSKSGNTASLTISGLQAADEADYYCNSYTRSGTWVFGGGTKVTVL

SEQ ID NO: 1024 - protein, 110 aa, Artificial Sequence
  Description of Artificial Sequence: Synthetic polypeptide
QSALTQPASVSGSPGQSITISCTGTSSDIGGYDFVSWYQQPPGKAPKLVIYEVNRRPSGLSNRFSGSRSGNTASLTVSGLQTEDEADYYCSSYAGSNNWVFGGGTKLTVL

SEQ ID NO: 1025 - protein, 107 aa, Artificial Sequence
  Description of Artificial Sequence: Synthetic polypeptide
SSELTQDPAVSVALGQTVRITCQGDSLRSYYASWYQQKPGQAPVLVIYGKNNRPSGIPDRFSGSSSGNTASLTITGAQAMDEADYYCQAWDSSTVVVFGGGTKVTVL

SEQ ID NO: 1026 - protein, 109 aa, Artificial Sequence
  Description of Artificial Sequence: Synthetic polypeptide
SSELTQDPAVSVALGQTVRITCQGDSLRNYYASWYQQKPGQAPVLVIYGKNNRPSGIPDRFSGSSSGNTASLTITGAQAEDEADYYCNSRDSSGNHLVVFGGGTKLTVL

SEQ ID NO: 1027 - protein, 110 aa, Artificial Sequence
  Description of Artificial Sequence: Synthetic polypeptide
QSALTQPASVSGSPGQSITISCTGTSSDVGGYNYVSWYQQHPGKAPKLLIYEVSSRPSGVSNRFSGSKSGNTASLTISGLQAEDEADYYCNSYTNSGSWVFGGGTKVTVL

SEQ ID NO: 1028 - protein, 111 aa, Artificial Sequence
  Description of Artificial Sequence: Synthetic polypeptide
SYELTQPPSVSGSPGQSITISCTGTSSDVGVYNYVSWYQQHPGKAPKLMIYEVSHRPSGVSNRFSGSKSDNTASLTISGLQAEDEADYYCTSYSSSSTRWVFGGGTKVTVL

SEQ ID NO: 1029 - protein, 110 aa, Artificial Sequence
  Description of Artificial Sequence: Synthetic polypeptide
QSVLTQPPSVSGAPGQKVTISCSGSNSNVGNHYLSWYQHLPGTAPRLLIFDNNKRPSGIPDRFSGSKSGASATLDITGLQTGDEADYFCGTWDSRLNVWVFGGGTKLTVL

SEQ ID NO: 1030 - protein, 106 aa, Artificial Sequence
  Description of Artificial Sequence: Synthetic polypeptide
SSELTQDPAVSVALGQTVRITCQGDSLRSYYASWYQQKPGQAPVLVIYGKNNRPSGIPDRFSGSNSGNTATLTISGTQAMDEADYYCQAWDSSTAVFGGGTKLTVL

SEQ ID NO: 1031 - protein, 106 aa, Artificial Sequence
  Description of Artificial Sequence: Synthetic polypeptide
SSELTQDPAVSVALGQTVRITCQGDSLTRYYASWYQQKPGQAPVLVIYGKNNRPSGIPDRFSGSNSGNTATLTISGTQAMDEADYYCQAWDSSTAVFGTGTKVTVL

SEQ ID NO: 1032 - protein, 109 aa, Artificial Sequence
  Description of Artificial Sequence: Synthetic polypeptide
SSELTQDPAVSVALGQTVRITCQGDSLRNYYASWYQQKPGQAPVLVFYGKNNRPSGIPDRFSGSSSGNTASLTITGAQAEDEADYYCNSRDSSGNHLVVFGGGTKLTVL

SEQ ID NO: 1033 - protein, 106 aa, Artificial Sequence
  Description of Artificial Sequence: Synthetic polypeptide
SYELTQPPSVSVAPGQTARITCGGNNIGSKSVHWYQQKSGQAPVLVVYDDTDRPSGTPERFSGSNSGNTATLTISGTQAMDEADYYCQAWDSSTAVFGTGTKVTVL

SEQ ID NO: 1034 - protein, 109 aa, Artificial Sequence
  Description of Artificial Sequence: Synthetic polypeptide
SSELTQDPAVSVALGQTVRITCQGDSLRSYYASWYQQKPGQAPILVIYGKNNRPSGIPDRFSGSSSGNTASLTITGAQAEDEADYYCNSRDSSGNLLYVFGTGTKLTVL

SEQ ID NO: 1035 - protein, 105 aa, Artificial Sequence
  Description of Artificial Sequence: Synthetic polypeptide
QSVLTQPPSVSVAPGKTARITCGGNNIGSKSVHWYQQKPGQAPVLVVYDDSDRPSGIPERFSGSNSGNTATLTISGTQAMDEADYYCQAWDSSTVFGGGTKLTVL

SEQ ID NO: 1036 - protein, 108 aa, Artificial Sequence
  Description of Artificial Sequence: Synthetic polypeptide
SYELTQSPSVSVAPGKTARITCGGNNIGSKSVHWYQQKPGQAPVLVIYYDSDRPSGIPERFSGSNSGNTATLTISRVEAGDEADYYCQVWDSSSDHPVFGGGTKVTVL

SEQ ID NO: 1037 - protein, 111 aa, Artificial Sequence
  Description of Artificial Sequence: Synthetic polypeptide
QSVLTQPASVSGSPGQSITISCTGTSSDVGSYNLVSWYQQHPGKAPKLMIYEVSKRPSGVSNRFSGSKSGNTASLTISGLQAEDEADYYCSSYRSNNTPWVFGGGTKLTVL

SEQ ID NO: 1038 - protein, 109 aa, Artificial Sequence; identical to SEQ ID NO: 1020
  Description of Artificial Sequence: Synthetic polypeptide

SEQ ID NO: 1039 - protein, 110 aa, Artificial Sequence
  Description of Artificial Sequence: Synthetic polypeptide
QSALTQPASVSGSPGQSITISCTGTSSDVGGYDYVSWYQQHPGKAPKLMIYEVSNRPSGVSNRFSGSKSGNTASLTISGLQAEDEADYYCSSYASSGSLLFGGGTKVTVL

SEQ ID NO: 1040 - protein, 110 aa, Artificial Sequence
  Description of Artificial Sequence: Synthetic polypeptide
QSVLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGVVFGGGTKVTVL

SEQ ID NO: 1041 - protein, 108 aa, Artificial Sequence
  Description of Artificial Sequence: Synthetic polypeptide
SYELTQPPSVSVALGQTVRITCQGDSLRSYYASWYQQKPGQAPVLVIYGKNNRPSGIPDRFSGSSSGNTASLTITGAQAEDEADYYCNSRDSSGNPWVFGGGTKVTVL

SEQ ID NO: 1042 - protein, 109 aa, Artificial Sequence; identical to SEQ ID NO: 1011
  Description of Artificial Sequence: Synthetic polypeptide

SEQ ID NO: 1043 - protein, 105 aa, Artificial Sequence
  Description of Artificial Sequence: Synthetic polypeptide
SSELTQDPAVSVALGQTVRITCQGDSLRSYYASWYQQKPGQAPVLVIYGKNNRPSGIPDRFSGSNSGNTATLTISGTQAMDEADYYCQAWDSSTVFGGGTKVTVL

SEQ ID NO: 1044 - protein, 106 aa, Artificial Sequence
  Description of Artificial Sequence: Synthetic polypeptide
SSELTQDPAVSVALGQTVRITCQGDSLRSYYASWYQQKPGQAPVLVIYGKNNRPSGIPDRFSGSSSGNTASLTITGAQAEDEADYYCQAWDSSTGVFGGGTKVTVL

SEQ ID NO: 1045 - protein, 111 aa, Artificial Sequence
  Description of Artificial Sequence: Synthetic polypeptide
QSVLTQPPSVSGAPGQRVTISCTGSSSNIGAGYDVHWYQQLPGTAPKLLIYGDSNRPSGVPDRFSGSGSGTSASLAITGLQAEDEGDYYCQSFDSNLSRYVFGAGTKLTVL

SEQ ID NO: 1046 - protein, 110 aa, Artificial Sequence
  Description of Artificial Sequence: Synthetic polypeptide
QSALTQPASVSGSPGQSITISCTGTNSDVGAYNYVSWYQQHPGKAPKLMIYEVTNRPSGVSNRFSGSKSGNTASLTISGLQAEDEADYYCSSYTSSGTWVFGGGTKLTVL

SEQ ID NO: 1047 - protein, 109 aa, Artificial Sequence; identical to SEQ ID NO: 1020
  Description of Artificial Sequence: Synthetic polypeptide

SEQ ID NO: 1048 - protein, 13 aa, Artificial Sequence
  Description of Artificial Sequence: Synthetic peptide
SGSSSNIGSDYVY

SEQ ID NO: 1049 - protein, 14 aa, Artificial Sequence
  Description of Artificial Sequence: Synthetic peptide
TGTSSDVGDYNYVS

SEQ ID NO: 1050 - protein, 11 aa, Artificial Sequence
  Description of Artificial Sequence: Synthetic peptide
GGRDIGSKSVH

SEQ ID NO: 1051 - protein, 11 aa, Artificial Sequence
  Description of Artificial Sequence: Synthetic peptide
QGDSLRSYYAS

SEQ ID NO: 1052 - protein, 11 aa, Artificial Sequence
  Description of Artificial Sequence: Synthetic peptide
SGDVLGENYAD

SEQ ID NO: 1053 - protein, 14 aa, Artificial Sequence
  Description of Artificial Sequence: Synthetic peptide
TGTSSDVGGYNSVS

SEQ ID NO: 1054 - protein, 14 aa, Artificial Sequence
  Description of Artificial Sequence: Synthetic peptide
TGSSSNIGAGYDVH

SEQ ID NO: 1055 - protein, 14 aa, Artificial Sequence
  Description of Artificial Sequence: Synthetic peptide
TGTSSDVGGYNSVS

SEQ ID NO: 1056 - protein, 14 aa, Artificial Sequence
  Description of Artificial Sequence: Synthetic peptide
TGTSSDVGGYDSVS

SEQ ID NO: 1057 - protein, 14 aa, Artificial Sequence
  Description of Artificial Sequence: Synthetic peptide
TGTSSDVGGYDYVS

SEQ ID NO: 1058 - protein, 11 aa, Artificial Sequence
  Description of Artificial Sequence: Synthetic peptide
QGDSLRSYYAS

SEQ ID NO: 1059 - protein, 13 aa, Artificial Sequence
  Description of Artificial Sequence: Synthetic peptide
SGSSSNIGWKTVN

SEQ ID NO: 1060 - protein, 14 aa, Artificial Sequence
  Description of Artificial Sequence: Synthetic peptide
TGTSSDVGAYDSVS

SEQ ID NO: 1061 - protein, 11 aa, Artificial Sequence
  Description of Artificial Sequence: Synthetic peptide
QGDSLRSYYAS

SEQ ID NO: 1062 - protein, 14 aa, Artificial Sequence
  Description of Artificial Sequence: Synthetic peptide
TGTSSDVGGYNYVS

SEQ ID NO: 1063 - protein, 11 aa, Artificial Sequence
  Description of Artificial Sequence: Synthetic peptide
SGDALPNQYAY

SEQ ID NO: 1064 - protein, 11 aa, Artificial Sequence
  Description of Artificial Sequence: Synthetic peptide
QGDSLRSYYAS

SEQ ID NO: 1065 - protein, 14 aa, Artificial Sequence
  Description of Artificial Sequence: Synthetic peptide
TGTSSDVGGYNYVS

SEQ ID NO: 1066 - protein, 11 aa, Artificial Sequence
  Description of Artificial Sequence: Synthetic peptide
AGNNIGSKNVH

SEQ ID NO: 1067 - protein, 14 aa, Artificial Sequence
  Description of Artificial Sequence: Synthetic peptide
TGTSSDVGGYNYVS

SEQ ID NO: 1068 - protein, 11 aa, Artificial Sequence
  Description of Artificial Sequence: Synthetic peptide
GGNNIGSKSVH

SEQ ID NO: 1069 - protein, 11 aa, Artificial Sequence
  Description of Artificial Sequence: Synthetic peptide
QGDSLRRFYAS

SEQ ID NO: 1070 - protein, 14 aa, Artificial Sequence
  Description of Artificial Sequence: Synthetic peptide
TGTSSDIGGYNFVS

SEQ ID NO: 1071 - protein, 11 aa, Artificial Sequence
  Description of Artificial Sequence: Synthetic peptide
QASQDISNYLN

SEQ ID NO: 1072 - protein, 11 aa, Artificial Sequence
  Description of Artificial Sequence: Synthetic peptide
QGDSLGRFYAS

SEQ ID NO: 1073 - protein, 11 aa, Artificial Sequence
  Description of Artificial Sequence: Synthetic peptide
QGDSLRSYYAS

SEQ ID NO: 1074 - protein, 13 aa, Artificial Sequence
  Description of Artificial Sequence: Synthetic peptide
SGSSSNIGSNYVY

SEQ ID NO: 1075 - protein, 14 aa, Artificial Sequence
  Description of Artificial Sequence: Synthetic peptide
TGTSSDVGGYNSVS

SEQ ID NO: 1076 - protein, 14 aa, Artificial Sequence
  Description of Artificial Sequence: Synthetic peptide
TGTSSDVGVYNYVS

SEQ ID NO: 1077 - protein, 14 aa, Artificial Sequence
  Description of Artificial Sequence: Synthetic peptide
TGTSSDIGGYDFVS

SEQ ID NO: 1078 - protein, 11 aa, Artificial Sequence
  Description of Artificial Sequence: Synthetic peptide
QGDSLRSYYAS

SEQ ID NO: 1079 - protein, 11 aa, Artificial Sequence
  Description of Artificial Sequence: Synthetic peptide
QGDSLRNYYAS

SEQ ID NO: 1080 - protein, 14 aa, Artificial Sequence
  Description of Artificial Sequence: Synthetic peptide
TGTSSDVGGYNYVS

SEQ ID NO: 1081 - protein, 14 aa, Artificial Sequence
  Description of Artificial Sequence: Synthetic peptide
TGTSSDVGVYNYVS

SEQ ID NO: 1082 - protein, 13 aa, Artificial Sequence
  Description of Artificial Sequence: Synthetic peptide
SGSNSNVGNHYLS

SEQ ID NO: 1083 - protein, 11 aa, Artificial Sequence
  Description of Artificial Sequence: Synthetic peptide
QGDSLRSYYAS

SEQ ID NO: 1084 - protein, 11 aa, Artificial Sequence
  Description of Artificial Sequence: Synthetic peptide
QGDSLTRYYAS

SEQ ID NO: 1085 - protein, 11 aa, Artificial Sequence
  Description of Artificial Sequence: Synthetic peptide
QGDSLRNYYAS

SEQ ID NO: 1086 - protein, 11 aa, Artificial Sequence
  Description of Artificial Sequence: Synthetic peptide
GGNNIGSKSVH

SEQ ID NO: 1087 - protein, 11 aa, Artificial Sequence
  Description of Artificial Sequence: Synthetic peptide
QGDSLRSYYAS

SEQ ID NO: 1088 - protein, 11 aa, Artificial Sequence
  Description of Artificial Sequence: Synthetic peptide
GGNNIGSKSVH

SEQ ID NO: 1089 - protein, 11 aa, Artificial Sequence
  Description of Artificial Sequence: Synthetic peptide
GGNNIGSKSVH

SEQ ID NO: 1090 - protein, 14 aa, Artificial Sequence
  Description of Artificial Sequence: Synthetic peptide
TGTSSDVGSYNLVS

SEQ ID NO: 1091 - protein, 11 aa, Artificial Sequence
  Description of Artificial Sequence: Synthetic peptide
QGDSLRSYYAS

SEQ ID NO: 1092 - protein, 14 aa, Artificial Sequence
  Description of Artificial Sequence: Synthetic peptide
TGTSSDVGGYDYVS

SEQ ID NO: 1093 - protein, 13 aa, Artificial Sequence
  Description of Artificial Sequence: Synthetic peptide
SGSSSNIGSNTVN

SEQ ID NO: 1094 - protein, 11 aa, Artificial Sequence
  Description of Artificial Sequence: Synthetic peptide
QGDSLRSYYAS

SEQ ID NO: 1095 - protein, 11 aa, Artificial Sequence
  Description of Artificial Sequence: Synthetic peptide
QGDSLRSYYAS

SEQ ID NO: 1096 - protein, 11 aa, Artificial Sequence
  Description of Artificial Sequence: Synthetic peptide
QGDSLRSYYAS

SEQ ID NO: 1097 - protein, 11 aa, Artificial Sequence
  Description of Artificial Sequence: Synthetic peptide
QGDSLRSYYAS

SEQ ID NO: 1098 - protein, 14 aa, Artificial Sequence
  Description of Artificial Sequence: Synthetic peptide
TGSSSNIGAGYDVH

SEQ ID NO: 1099 - protein, 14 aa, Artificial Sequence
  Description of Artificial Sequence: Synthetic peptide
TGTNSDVGAYNYVS

SEQ ID NO: 1100 - protein, 11 aa, Artificial Sequence
  Description of Artificial Sequence: Synthetic peptide
QGDSLRSYYAS

SEQ ID NO: 1101 - protein, 8 aa, Artificial Sequence
  Description of Artificial Sequence: Synthetic peptide
YRDNQRPS

SEQ ID NO: 1102 - protein, 8 aa, Artificial Sequence
  Description of Artificial Sequence: Synthetic peptide
YDVSNRPS

SEQ ID NO: 1103 - protein, 8 aa, Artificial Sequence
  Description of Artificial Sequence: Synthetic peptide
YDDSDRPS

SEQ ID NO: 1104 - protein, 8 aa, Artificial Sequence
  Description of Artificial Sequence: Synthetic peptide
YGKNNRPS

SEQ ID NO: 1105 - protein, 8 aa, Artificial Sequence
  Description of Artificial Sequence: Synthetic peptide
YEDSERYP

SEQ ID NO: 1106 - protein, 8 aa, Artificial Sequence
  Description of Artificial Sequence: Synthetic peptide
YDVTNRPS

SEQ ID NO: 1107 - protein, 8 aa, Artificial Sequence
  Description of Artificial Sequence: Synthetic peptide
HGNTNRPS

SEQ ID NO: 1108 - protein, 8 aa, Artificial Sequence
  Description of Artificial Sequence: Synthetic peptide
YDVTNRPS

SEQ ID NO: 1109 - protein, 8 aa, Artificial Sequence
  Description of Artificial Sequence: Synthetic peptide
YDVSNRPS

SEQ ID NO: 1110 - protein, 8 aa, Artificial Sequence
  Description of Artificial Sequence: Synthetic peptide
YEVTDRPS

SEQ ID NO: 1111 - protein, 8 aa, Artificial Sequence
  Description of Artificial Sequence: Synthetic peptide
YQDSKRPS

SEQ ID NO: 1112 - protein, 8 aa, Artificial Sequence
  Description of Artificial Sequence: Synthetic peptide
YSDNQRPS

SEQ ID NO: 1113 - protein, 8 aa, Artificial Sequence
  Description of Artificial Sequence: Synthetic peptide
YDVTNRPS

SEQ ID NO: 1114 - protein, 8 aa, Artificial Sequence
  Description of Artificial Sequence: Synthetic peptide
YGKNNRPS

SEQ ID NO: 1115 - protein, 8 aa, Artificial Sequence
  Description of Artificial Sequence: Synthetic peptide
YDVDKRPS

SEQ ID NO: 1116 - protein, 8 aa, Artificial Sequence
  Description of Artificial Sequence: Synthetic peptide
YQDSERPS

SEQ ID NO: 1117 - protein, 8 aa, Artificial Sequence
  Description of Artificial Sequence: Synthetic peptide
YGKNNRPS

SEQ ID NO: 1118 - protein, 8 aa, Artificial Sequence
  Description of Artificial Sequence: Synthetic peptide
YDVTNRPS

SEQ ID NO: 1119 - protein, 9 aa, Artificial Sequence
  Description of Artificial Sequence: Synthetic peptide
YNDNIRPNF

SEQ ID NO: 1120 - protein, 8 aa, Artificial Sequence
  Description of Artificial Sequence: Synthetic peptide
FEVSYRPS

SEQ ID NO: 1121 - protein, 8 aa, Artificial Sequence
  Description of Artificial Sequence: Synthetic peptide
YDDSDRPS

SEQ ID NO: 1122 - protein, 8 aa, Artificial Sequence
  Description of Artificial Sequence: Synthetic peptide
YAENNRPS

SEQ ID NO: 1123 - protein, 8 aa, Artificial Sequence
  Description of Artificial Sequence: Synthetic peptide
YEVSNRPS

SEQ ID NO: 1124 - protein, 8 aa, Artificial Sequence
  Description of Artificial Sequence: Synthetic peptide
YDASNLET

SEQ ID NO: 1125 - protein, 8 aa, Artificial Sequence
  Description of Artificial Sequence: Synthetic peptide
YGKNNRPS

SEQ ID NO: 1126 - protein, 8 aa, Artificial Sequence
  Description of Artificial Sequence: Synthetic peptide
YGKNNRPS

SEQ ID NO: 1127 - protein, 8 aa, Artificial Sequence
  Description of Artificial Sequence: Synthetic peptide
YRNNQRPS

SEQ ID NO: 1128 - protein, 8 aa, Artificial Sequence
  Description of Artificial Sequence: Synthetic peptide
YDVSDRPS

SEQ ID NO: 1129 - protein, 8 aa, Artificial Sequence
  Description of Artificial Sequence: Synthetic peptide
YDVGIRPS

SEQ ID NO: 1130 - protein, 8 aa, Artificial Sequence
  Description of Artificial Sequence: Synthetic peptide
YEVNRRPS

SEQ ID NO: 1131 - protein, 8 aa, Artificial Sequence
  Description of Artificial Sequence: Synthetic peptide
YGKNNRPS

SEQ ID NO: 1132 - protein, 8 aa, Artificial Sequence
  Description of Artificial Sequence: Synthetic peptide
YGKNNRPS

SEQ ID NO: 1133 - protein, 8 aa, Artificial Sequence
  Description of Artificial Sequence: Synthetic peptide
YEVSSRPS

SEQ ID NO: 1134 - protein, 8 aa, Artificial Sequence
  Description of Artificial Sequence: Synthetic peptide
YEVSHRPS

SEQ ID NO: 1135 - protein, 8 aa, Artificial Sequence
  Description of Artificial Sequence: Synthetic peptide
FDNNKRPS

SEQ ID NO: 1136 - protein, 8 aa, Artificial Sequence
  Description of Artificial Sequence: Synthetic peptide
YGKNNRPS

SEQ ID NO: 1137 - protein, 8 aa, Artificial Sequence
  Description of Artificial Sequence: Synthetic peptide
YGKNNRPS

SEQ ID NO: 1138 - protein, 8 aa, Artificial Sequence
  Description of Artificial Sequence: Synthetic peptide
YGKNNRPS

SEQ ID NO: 1139 - protein, 8 aa, Artificial Sequence
  Description of Artificial Sequence: Synthetic peptide
YDDTDRPS

SEQ ID NO: 1140 - protein, 8 aa, Artificial Sequence
  Description of Artificial Sequence: Synthetic peptide
YGKNNRPS

SEQ ID NO: 1141 - protein, 8 aa, Artificial Sequence
  Description of Artificial Sequence: Synthetic peptide
YDDSDRPS

SEQ ID NO: 1142 - protein, 8 aa, Artificial Sequence
  Description of Artificial Sequence: Synthetic peptide
YYDSDRPS

SEQ ID NO: 1143 - protein, 8 aa, Artificial Sequence
  Description of Artificial Sequence: Synthetic peptide
YEVSKRPS

SEQ ID NO: 1144 - protein, 8 aa, Artificial Sequence
  Description of Artificial Sequence: Synthetic peptide
YGKNNRPS

SEQ ID NO: 1145 - protein, 8 aa, Artificial Sequence
  Description of Artificial Sequence: Synthetic peptide
YEVSNRPS

SEQ ID NO: 1146 - protein, 8 aa, Artificial Sequence
  Description of Artificial Sequence: Synthetic peptide
YSNNQRPS

SEQ ID NO: 1147 - protein, 8 aa, Artificial Sequence
  Description of Artificial Sequence: Synthetic peptide
YGKNNRPS

SEQ ID NO: 1148 - protein, 8 aa, Artificial Sequence
  Description of Artificial Sequence: Synthetic peptide
YGKNNRPS

SEQ ID NO: 1149 - protein, 8 aa, Artificial Sequence
  Description of Artificial Sequence: Synthetic peptide
YGKNNRPS

SEQ ID NO: 1150 - protein, 8 aa, Artificial Sequence
  Description of Artificial Sequence: Synthetic peptide
YGKNNRPS

SEQ ID NO: 1151 - protein, 8 aa, Artificial Sequence
  Description of Artificial Sequence: Synthetic peptide
YGDSNRPS

SEQ ID NO: 1152 - protein, 8 aa, Artificial Sequence
  Description of Artificial Sequence: Synthetic peptide
YEVTNRPS

SEQ ID NO: 1153 - protein, 8 aa, Artificial Sequence
  Description of Artificial Sequence: Synthetic peptide
YGKNNRPS

SEQ ID NO: 1154 - protein, 11 aa, Artificial Sequence
  Description of Artificial Sequence: Synthetic peptide
AAWDDSLSGWV

SEQ ID NO: 1155 - protein, 10 aa, Artificial Sequence
  Description of Artificial Sequence: Synthetic peptide
GSYTGSDTWV

SEQ ID NO: 1156 - protein, 10 aa, Artificial Sequence
  Description of Artificial Sequence: Synthetic peptide
QVWDSSTDVV

SEQ ID NO: 1157 - protein, 10 aa, Artificial Sequence
  Description of Artificial Sequence: Synthetic peptide
QAWDSSTGVV

SEQ ID NO: 1158 - protein, 9 aa, Artificial Sequence
  Description of Artificial Sequence: Synthetic peptide
LSGDEDNRV

SEQ ID NO: 1159 - protein, 10 aa, Artificial Sequence
  Description of Artificial Sequence: Synthetic peptide
SSSSISATWV

SEQ ID NO: 1160 - protein, 12 aa, Artificial Sequence
  Description of Artificial Sequence: Synthetic peptide
QSYDNSLGGYVV

SEQ ID NO: 1161 - protein, 10 aa, Artificial Sequence
  Description of Artificial Sequence: Synthetic peptide
SSSSISATWV

SEQ ID NO: 1162 - protein, 12 aa, Artificial Sequence
  Description of Artificial Sequence: Synthetic peptide
SSYTSSTTLGWI

SEQ ID NO: 1163 - protein, 11 aa, Artificial Sequence
  Description of Artificial Sequence: Synthetic peptide
SSYTYTSTLEV

SEQ ID NO: 1164 - protein, 9 aa, Artificial Sequence
  Description of Artificial Sequence: Synthetic peptide
QAWDSSTAV

SEQ ID NO: 1165 - protein, 11 aa, Artificial Sequence
  Description of Artificial Sequence: Synthetic peptide
ASWDASVNAPV

SEQ ID NO: 1166 - protein, 11 aa, Artificial Sequence
  Description of Artificial Sequence: Synthetic peptide
ISYTASSTYVV

SEQ ID NO: 1167 - protein, 11 aa, Artificial Sequence
  Description of Artificial Sequence: Synthetic peptide
NSRDSSGNPWV

SEQ ID NO: 1168 - protein, 10 aa, Artificial Sequence
  Description of Artificial Sequence: Synthetic peptide
QAWDSSTEVV

SEQ ID NO: 1169 - protein, 11 aa, Artificial Sequence
  Description of Artificial Sequence: Synthetic peptide
QSADTYGTSWV

SEQ ID NO: 1170 - protein, 12 aa, Artificial Sequence
  Description of Artificial Sequence: Synthetic peptide
NSRDSSGNHLVV

SEQ ID NO: 1171 - protein, 9 aa, Artificial Sequence
  Description of Artificial Sequence: Synthetic peptide
SSYAGSHEL

SEQ ID NO: 1172 - protein, 10 aa, Artificial Sequence
  Description of Artificial Sequence: Synthetic peptide
QVWDSSTAEV

SEQ ID NO: 1173 - protein, 11 aa, Artificial Sequence
  Description of Artificial Sequence: Synthetic peptide
AAWDDSLKGYV

SEQ ID NO: 1174 - protein, 10 aa, Artificial Sequence
  Description of Artificial Sequence: Synthetic peptide
QVWDSSTPYV

SEQ ID NO: 1175 - protein, 11 aa, Artificial Sequence
  Description of Artificial Sequence: Synthetic peptide
NSRDSSGNRHV

SEQ ID NO: 1176 - protein, 10 aa, Artificial Sequence
  Description of Artificial Sequence: Synthetic peptide
SSYTSSSAWV

SEQ ID NO: 1177 - protein, 9 aa, Artificial Sequence
  Description of Artificial Sequence: Synthetic peptide
QQYDNLPLT

SEQ ID NO: 1178 - protein, 12 aa, Artificial Sequence
  Description of Artificial Sequence: Synthetic peptide
NSRDSSGNHLVV

SEQ ID NO: 1179 - protein, 12 aa, Artificial Sequence
  Description of Artificial Sequence: Synthetic peptide
NSRDSSGNHLVV

SEQ ID NO: 1180 - protein, 11 aa, Artificial Sequence
  Description of Artificial Sequence: Synthetic peptide
AAWDDSLSGYV

SEQ ID NO: 1181 - protein, 10 aa, Artificial Sequence
  Description of Artificial Sequence: Synthetic peptide
SSYAGSNNVV

SEQ ID NO: 1182 - protein, 10 aa, Artificial Sequence
  Description of Artificial Sequence: Synthetic peptide
NSYTRSGTWV

SEQ ID NO: 1183 - protein, 10 aa, Artificial Sequence
  Description of Artificial Sequence: Synthetic peptide
SSYAGSNNWV

SEQ ID NO: 1184 - protein, 10 aa, Artificial Sequence
  Description of Artificial Sequence: Synthetic peptide
QAWDSSTVVV

SEQ ID NO: 1185 - protein, 12 aa, Artificial Sequence
  Description of Artificial Sequence: Synthetic peptide
NSRDSSGNHLVV

SEQ ID NO: 1186 - protein, 10 aa, Artificial Sequence
  Description of Artificial Sequence: Synthetic peptide
NSYTNSGSWV

SEQ ID NO: 1187 - protein, 11 aa, Artificial Sequence
  Description of Artificial Sequence: Synthetic peptide
TSYSSSSTRWV

SEQ ID NO: 1188 - protein, 11 aa, Artificial Sequence
  Description of Artificial Sequence: Synthetic peptide
GTWDSRLNVWV

SEQ ID NO: 1189 - protein, 9 aa, Artificial Sequence
  Description of Artificial Sequence: Synthetic peptide
QAWDSSTAV

SEQ ID NO: 1190 - protein, 9 aa, Artificial Sequence
  Description of Artificial Sequence: Synthetic peptide
QAWDSSTAV

SEQ ID NO: 1191 - protein, 12 aa, Artificial Sequence
  Description of Artificial Sequence: Synthetic peptide
NSRDSSGNHLVV

SEQ ID NO: 1192 - protein, 9 aa, Artificial Sequence
  Description of Artificial Sequence: Synthetic peptide
QAWDSSTAV

SEQ ID NO: 1193 - protein, 12 aa, Artificial Sequence
  Description of Artificial Sequence: Synthetic peptide
NSRDSSGNLLYV

SEQ ID NO: 1194 - protein, 8 aa, Artificial Sequence
  Description of Artificial Sequence: Synthetic peptide
QAWDSSTV

SEQ ID NO: 1195 - protein, 11 aa, Artificial Sequence
  Description of Artificial Sequence: Synthetic peptide
QVWDSSSDHPV

SEQ ID NO: 1196 - protein, 11 aa, Artificial Sequence
  Description of Artificial Sequence: Synthetic peptide
SSYRSNNTPWV

SEQ ID NO: 1197 - protein, 12 aa, Artificial Sequence
  Description of Artificial Sequence: Synthetic peptide
NSRDSSGNHLVV

SEQ ID NO: 1198 - protein, 10 aa, Artificial Sequence
  Description of Artificial Sequence: Synthetic peptide
SSYASSGSLL

SEQ ID NO: 1199 - protein, 11 aa, Artificial Sequence
  Description of Artificial Sequence: Synthetic peptide
AAWDDSLNGVV

SEQ ID NO: 1200 - protein, 11 aa, Artificial Sequence
  Description of Artificial Sequence: Synthetic peptide
NSRDSSGNPWV

SEQ ID NO: 1201 - protein, 12 aa, Artificial Sequence
  Description of Artificial Sequence: Synthetic peptide
NSRDSSGNHLVV

SEQ ID NO: 1202 - protein, 8 aa, Artificial Sequence
  Description of Artificial Sequence: Synthetic peptide
QAWDSSTV

SEQ ID NO: 1203 - protein, 9 aa, Artificial Sequence
  Description of Artificial Sequence: Synthetic peptide
QAWDSSTGV

SEQ ID NO: 1204 - protein, 11 aa, Artificial Sequence
  Description of Artificial Sequence: Synthetic peptide
QSFDSNLSRYV

SEQ ID NO: 1205 - protein, 10 aa, Artificial Sequence
  Description of Artificial Sequence: Synthetic peptide
SSYTSSGTWV

SEQ ID NO: 1206 - protein, 12 aa, Artificial Sequence
  Description of Artificial Sequence: Synthetic peptide
NSRDSSGNHLVV

SEQ ID NO: 1207 - protein, 246 aa, Artificial Sequence
  Description of Artificial Sequence: Synthetic polypeptide
EVQLVESGGGVVRPGGSLRLSCAASGFTFDDYGVSWVRQAPGRGLEWVSGINWNGGSTAYADSVKGRFTISRDSAKNSLYLQMDSLRAEDTALYYCAREEGSYYVWYFDIWGRGTLVTVSSGSTSGSGKPGSGEGSTKGDIQMTQSPSSLSASVGDRVTITCRPSQSISNYLNWYQQKPGKAPKVLIYASFILQSGVPSRFGGSGSGTDFTLTISSLQPEDFATYYCQQSYSNPFTFGPGTKVDIK

SEQ ID NO: 1208 - protein, 246 aa, Artificial Sequence
  Description of Artificial Sequence: Synthetic polypeptide
DIQMTQSPSSLSASVGDRVTITCRPSQSISNYLNWYQQKPGKAPKVLIYASFILQSGVPSRFGGSGSGTDFTLTISSLQPEDFATYYCQQSYSNPFTFGPGTKVDIKGSTSGSGKPGSGEGSTKGEVQLVESGGGVVRPGGSLRLSCAASGFTFDDYGVSWVRQAPGRGLEWVSGINWNGGSTAYADSVKGRFTISRDSAKNSLYLQMDSLRAEDTALYYCAREEGSYYVWYFDIWGRGTLVTVSS

SEQ ID NO: 1209 - protein, 245 aa, Artificial Sequence
  Description of Artificial Sequence: Synthetic polypeptide
QVQLVESGGGVVQPGRSLRLSCAASGFTFSNYGMYWVRQAPGKGLEWVAVIWYDGSKKYYGDSVKGRFTISRDNSKNTLYLQMNSLRAEDTAVYYCARDEDTVMASFDYWGQGTLVTVSSGSTSGSGKPGSGEGSTKGDIQLTQSPSFLSASVGDRVTITCRASQDISIYLAWYQQKPGKAPQLLIYAASTLQSGVPSRFSGSGSGTEFTLTISSLQPEDFATYSCQQLNSYPITFGGGTKVEIK

SEQ ID NO: 1210 - protein, 245 aa, Artificial Sequence
  Description of Artificial Sequence: Synthetic polypeptide
DIQLTQSPSFLSASVGDRVTITCRASQDISIYLAWYQQKPGKAPQLLIYAASTLQSGVPSRFSGSGSGTEFTLTISSLQPEDFATYSCQQLNSYPITFGGGTKVEIKGSTSGSGKPGSGEGSTKGQVQLVESGGGVVQPGRSLRLSCAASGFTFSNYGMYWVRQAPGKGLEWVAVIWYDGSKKYYGDSVKGRFTISRDNSKNTLYLQMNSLRAEDTAVYYCARDEDTVMASFDYWGQGTLVTVSS

SEQ ID NO: 1211 - protein, 244 aa, Artificial Sequence
  Description of Artificial Sequence: Synthetic polypeptide
QVQLVQSGAEVKKPGASVKVSCKASGYSFTGYYMHWVRQAPGQGLEWMGWINPKSGGTSYAQQFQGRVTMTRDTSMSTVYMELTRLRADDTAVYYCARLYYSGWYGDYWGQGTLVTVSSGSTSGSGKPGSGEGSTKGDIQMTQSPSSLSASVGDRVTITCQASQDINNYLNWYQQKPGKVPNLLIYDASNLETGVPSRFSGSGSGTDFTFTISSLQPEDIATYYCQQYNNPPITFGQGTRLEIK

SEQ ID NO: 1212 - protein, 244 aa, Artificial Sequence
  Description of Artificial Sequence: Synthetic polypeptide
DIQMTQSPSSLSASVGDRVTITCQASQDINNYLNWYQQKPGKVPNLLIYDASNLETGVPSRFSGSGSGTDFTFTISSLQPEDIATYYCQQYNNPPITFGQGTRLEIKGSTSGSGKPGSGEGSTKGQVQLVQSGAEVKKPGASVKVSCKASGYSFTGYYMHWVRQAPGQGLEWMGWINPKSGGTSYAQQFQGRVTMTRDTSMSTVYMELTRLRADDTAVYYCARLYYSGWYGDYWGQGTLVTVSS

SEQ ID NO: 1213 - protein, 245 aa, Artificial Sequence
  Description of Artificial Sequence: Synthetic polypeptide
QVQLVESGGGVVQPGRSLRLSCAASGFTFSSYGLHWVRQAPGKGLDWVAVIWYDGSNKYYVDSVKGRFTISRDNSMNTLFLQMNSLRAEDTAVYYCARDEAAAAGAFDIWGQGTMVTVSSGSTSGSGKPGSGEGSTKGDIQLTQSPSFLSASVGDRVTITCRASQGISSYLAWYQQKPGKAPKLLIYAASTLQSGVPSRFSGSGSGTEFTLTISSLQPEDFATYYCQQLNYYSITFGQGTRLEIK

SEQ ID NO: 1214 - protein, 245 aa, Artificial Sequence
  Description of Artificial Sequence: Synthetic polypeptide
DIQLTQSPSFLSASVGDRVTITCRASQGISSYLAWYQQKPGKAPKLLIYAASTLQSGVPSRFSGSGSGTEFTLTISSLQPEDFATYYCQQLNYYSITFGQGTRLEIKGSTSGSGKPGSGEGSTKGQVQLVESGGGVVQPGRSLRLSCAASGFTFSSYGLHWVRQAPGKGLDWVAVIWYDGSNKYYVDSVKGRFTISRDNSMNTLFLQMNSLRAEDTAVYYCARDEAAAAGAFDIWGQGTMVTVSS

SEQ ID NO: 1215 - protein, 248 aa, Artificial Sequence
  Description of Artificial Sequence: Synthetic polypeptide
EVQLVESGGVVVQPGGSLRLSCAASGFTFDDYTMHWVRQAPGKGLEWVSLVSWDGGSTYYADSVKGRFTTSRDNSKKFLYLQMNRLRTEDTALYFCAIDRAYRPYYYYHMDVWGKGTTVTVSSGSTSGSGKPGSGEGSTKGDIQMTQSPSSLSASVGDRVTITCQASQDISNYLNWYQQKPGKAPKLLIYDASNLETGVPSRFSGSGSGTDFTFTISSLQPEDIATYYCQQYDNLPITFGQGTRLEIK

SEQ ID NO: 1216 - protein, 248 aa, Artificial Sequence
  Description of Artificial Sequence: Synthetic polypeptide
GDIQMTQSPSSLSASVGDRVTITCQASQDISNYLNWYQQKPGKAPKLLIYDASNLETGVPSRFSGSGSGTDFTFTISSLQPEDIATYYCQQYDNLPITFGQGTRLEIKGSTSGSGKPGSGEGSTKEVQLVESGGVVVQPGGSLRLSCAASGFTFDDYTMHWVRQAPGKGLEWVSLVSWDGGSTYYADSVKGRFTTSRDNSKKFLYLQMNRLRTEDTALYFCAIDRAYRPYYYYHMDVWGKGTTVTVSS

SEQ ID NO: 1217 - protein, 248 aa, Artificial Sequence
  Description of Artificial Sequence: Synthetic polypeptide
QLQLQESGPGLVKPSETLSLTCTVSGASITSTSYYWNWIRQPPGKGLEWIGRISYSGSTYYNPSLKSRVTISVDTSKNQFSLKLSSVTATDTAVYYCARQIRYNWNPDTFDIWGQGTMVTVSSGSTSGSGKPGSGEGSTKGEIVMTQSPATLSVSPGERATLSCRASQSLNSNLAWYQQKPAQAPRLLIYGASTRATGIPARFSGSGSGTEFTLTISSLQSEDFAVYYCQQYDNWPLTFGGGTKVEIK

SEQ ID NO: 1218 - protein, 248 aa, Artificial Sequence
  Description of Artificial Sequence: Synthetic polypeptide
EIVMTQSPATLSVSPGERATLSCRASQSLNSNLAWYQQKPAQAPRLLIYGASTRATGIPARFSGSGSGTEFTLTISSLQSEDFAVYYCQQYDNWPLTFGGGTKVEIKGSTSGSGKPGSGEGSTKGQLQLQESGPGLVKPSETLSLTCTVSGASITSTSYYWNWIRQPPGKGLEWIGRISYSGSTYYNPSLKSRVTISVDTSKNQFSLKLSSVTATDTAVYYCARQIRYNWNPDTFDIWGQGTMVTVSS

SEQ ID NO: 1219 - protein, 247 aa, Artificial Sequence
  Description of Artificial Sequence: Synthetic polypeptide
EVQLVESGGGLVKPGGSLRLSCAASGFTFSSYSMNWVRQAPGKGLEWVSLISSSSRFIYYADSVKGRFTVSRDNAKKSLYLLLNSLRAEDTAVYYCARGDYSNYPYFDYWGQGTLVTVSSGSTSGSGKPGSGEGSTKGEIVLTQSPATLSLSPGERATLSCRASQSVRSSYLAWYQQKPGQPPRLLIFGASSRATGIPDRFSGSGSGTDFTLTISRLEPEDFAVYYCQQYGDSPALTFGGGTKVEIK

SEQ ID NO: 1220 - protein, 247 aa, Artificial Sequence
  Description of Artificial Sequence: Synthetic polypeptide
EIVLTQSPATLSLSPGERATLSCRASQSVRSSYLAWYQQKPGQPPRLLIFGASSRATGIPDRFSGSGSGTDFTLTISRLEPEDFAVYYCQQYGDSPALTFGGGTKVEIKGSTSGSGKPGSGEGSTKGEVQLVESGGGLVKPGGSLRLSCAASGFTFSSYSMNWVRQAPGKGLEWVSLISSSSRFIYYADSVKGRFTVSRDNAKKSLYLLLNSLRAEDTAVYYCARGDYSNYPYFDYWGQGTLVTVSS

SEQ ID NO: 1221 - protein, 245 aa, Artificial Sequence
  Description of Artificial Sequence: Synthetic polypeptide
EVQLVESGGGLVKPGGSLRLSCAASGFTFSSYSMNWVRQAPGKGLEWVSLISSSSRFIYYADSVKGRFTVSRDNAKKSLYLLLNSLRAEDTAVYYCARGDYSNYPYFDYWGQGTLVTVSSGSTSGSGKPGSGEGSTKGDIQMTQSPSNLSASVGDRVTITCRASQSISSWLAWYQQKPGKAPKLLIYKASSLESGVPSRFSGSGSGTEFTLTISSLQPDDFAGYYCQHYNTYSPTFGQGTKVEIK

SEQ ID NO: 1222 - protein, 245 aa, Artificial Sequence
  Description of Artificial Sequence: Synthetic polypeptide
DIQMTQSPSNLSASVGDRVTITCRASQSISSWLAWYQQKPGKAPKLLIYKASSLESGVPSRFSGSGSGTEFTLTISSLQPDDFAGYYCQHYNTYSPTFGQGTKVEIKGSTSGSGKPGSGEGSTKGEVQLVESGGGLVKPGGSLRLSCAASGFTFSSYSMNWVRQAPGKGLEWVSLISSSSRFIYYADSVKGRFTVSRDNAKKSLYLLLNSLRAEDTAVYYCARGDYSNYPYFDYWGQGTLVTVSS

SEQ ID NO: 1223 - skipped

SEQ ID NO: 1224 - protein, 116 aa, Artificial Sequence
  Description of Artificial Sequence: Synthetic polypeptide
EVQLVESGGGLVQPGGSLRLSCAASGSIFSIARMNWYRQAPGKQRELVAILNRAGRTDYADSVKGRFTISSDNAKNTLYLQMNSLRPEDTAVYYCNLQTISYHDFWGQGTQVTVSS

SEQ ID NO: 1225 - protein, 116 aa, Artificial Sequence
  Description of Artificial Sequence: Synthetic polypeptide
EVQLVESGGGLVQPGGSLRLSCAASGSIFSIARMNWYRQAPGKQRELVSILNRAGRTDYADSVKGRFTISRDNAKNTLYLQMNSLRPEDTAVYYCNLQTISYHDFWGQGTQVTVSS

SEQ ID NO: 1226 - protein, 116 aa, Artificial Sequence
  Description of Artificial Sequence: Synthetic polypeptide
EVQLVESGGGLVQPGGSLRLSCAASGSIFSIARMNWYRQAPGKQRELVSILNRAGRTYYADSVKGRFTISRDNAKNTLYLQMNSLRPEDTAVYYCNLQTISYHDFWGQGTQVTVSS

SEQ ID NO: 1227 - protein, 116 aa, Artificial Sequence
  Description of Artificial Sequence: Synthetic polypeptide
EVQLVESGGGLVQPGGSLRLSCAASGSIFSIARMSWYRQAPGKQRELVSILNRAGRTYYADSVKGRFTISRDNAKNTLYLQMNSLRPEDTAVYYCNLQTISYHDFWGQGTQVTVSS

SEQ ID NO: 1228 - protein, 288 aa, Homo sapiens
MQIPQAPWPVVWAVLQLGWRPGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERRAEVPTAHPSPSPRPAGQFQTLVVGVVGGLLGSLVLLVWVLAVICSRAARGTIGARRTGQPLKEDPSAVPVFSVDYGELDFQWREKTPEPPVPCVPEQTEYATIVFPSGMGTSSPARRGSADGPRSAQPLRPEDGHCSWPL

SEQ ID NO: 1229 - protein, 288 aa, Mus musculus
MWVRQVPWSFTWAVLQLSWQSGWLLEVPNGPWRSLTFYPAWLTVSEGANATFTCSLSNWSEDLMLNWNRLSPSNQTEKQAAFCNGLSQPVQDARFQIIQLPNRHDFHMNILDTRRNDSGIYLCGAISLHPKAKIEESPGAELVVTERILETSTRYPSPSPKPEGRFQGMVIGIMSALVGIPVLLLLAWALAVFCSTSMSEARGAGSKDDTLKEEPSAAPVPSVAYEELDFQGREKTPELPTACVHTEYATIVFTEGLGASAMGRRGSADGLQGPRPPRHEDGHCSWPL

SEQ ID NO: 1230 - protein, 23 aa, Artificial Sequence
  Description of Artificial Sequence: Synthetic peptide
HRDGIYMVHIQVTLAICSSTTAS

SEQ ID NO: 1231 - protein, 23 aa, Artificial Sequence
  Description of Artificial Sequence: Synthetic peptide
ASRHHPTTLAVGICSPASRSISL

SEQ ID NO: 1232 - protein, 5 aa, Artificial Sequence
  Description of Artificial Sequence: Synthetic peptide
GGGGS

SEQ ID NO: 1233 - protein, 343 aa, Artificial Sequence
  Description of Artificial Sequence: Synthetic polypeptide
MLLLVTSLLLCELPHPAFLLIPQVQLQESGGGLVQPGGSLRLSCVASGSIFSIARMNWYRQAPGKQRELVAILNRAGRTDYADSVKGRFTISSDNAKTTVYLQMNSLKPEDTALYYCNLQTISYHDFWGQGTQVTVSSAAAGGGGSGGGGSGGGGSLEDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRI

SEQ ID NO: 1234 - protein, 22 aa, Artificial Sequence
  Description of Artificial Sequence: Synthetic peptide
MLLLVTSLLLCELPHPAFLLIP

SEQ ID NO: 1235 - protein, 185 aa, Artificial Sequence
  Description of Artificial Sequence: Synthetic polypeptide
DGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRI

SEQ ID NO: 1236 - protein, 473 aa, Artificial Sequence
  Description of Artificial Sequence: Synthetic polypeptide
MLLLVTSLLLCELPHPAFLLIPQSALTQPRSVSGSPGQSVTISCTGTSSDVGGYNYVSWYQQHPGKAPKLMIYDVTNRPSGVPDRFSASKSDNTATLTVSGVQAEDEADYYCSSYAGSHELFGGGTKLTVLGSTSGSGKPGSGEGSTKGEVQLVQSGAEVKKPGESLKISCKGSGYSFTSYWIGWVRQMPGKGLEWMGIIYPGDSDTRYSPSFQGQVTISADKSISTAYLQWSSLKASDTAMYYCAISRTESYVMDVWGQGTTVTVSSAAAGGGGSGGGGSGGGGSLEDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRI

SEQ ID NO: 1237 - protein, 18 aa, Artificial Sequence
  Description of Artificial Sequence: Synthetic peptide
GSTSGSGKPGSGEGSTKG

SEQ ID NO: 1238 - protein, 21 aa, Artificial Sequence
  Description of Artificial Sequence: Synthetic peptide
GSGEGRGSLLTCGDVEENPGP

SEQ ID NO: 1239 - protein, 232 aa, Artificial Sequence
  Description of Artificial Sequence: Synthetic polypeptide
MQIPQAPWPVVWAVLQLGWRPGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERRAEVPTAHPSPSPRPAGQFQTLVVGVVGGLLGSLVLLVWVLAVIRSKRSRLLHSDYMNMTPRRPGPTRKHYQPYAPPRDFAAYRS

SEQ ID NO: 1240 - protein, 919 aa, Artificial Sequence
  Description of Artificial Sequence: Synthetic polypeptide
MLLLVTSLLLCELPHPAFLLIPQSALTQPRSVSGSPGQSVTISCTGTSSDVGGYNYVSWYQQHPGKAPKLMIYDVTNRPSGVPDRFSASKSDNTATLTVSGVQAEDEADYYCSSYAGSHELFGGGTKLTVLGSTSGSGKPGSGEGSTKGEVQLVQSGAEVKKPGESLKISCKGSGYSFTSYWIGWVRQMPGKGLEWMGIIYPGDSDTRYSPSFQGQVTISADKSISTAYLQWSSLKASDTAMYYCAISRTESYVMDVWGQGTTVTVSSAAAGGGGSGGGGSGGGGSLEDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRIGSGEGRGSLLTCGDVEENPGPMRISKPHLRSISIQCYLCLLLNSHFLTEAGIHVFILGCFSAGLPKTEANWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSSGGGSGGGGSGGGGSGGGGSGGGSLQITCPPPMSVEHADIWVKSYSLYSRERYICNSGFKRKAGTSSLTECVLNKATNVAHWTTPSLKCIRDPALVHQRPAPPSTVTTAGVTPQPESLSPSGKEPAASSPSSNNTAATTAAIVPGSQLMPSKSPSTGTTEISSHESSHGTPSQTTAKNWELTASASHQPPGVYPQGHSDTTVAISTSTVLLCGLSAVSLLACYLKSRQTPPLASVEMEAMEALPVTWGTSSRDEDLENCSHHL

SEQ ID NO: 1241 - protein, 425 aa, Artificial Sequence
  Description of Artificial Sequence: Synthetic polypeptide
MRISKPHLRSISIQCYLCLLLNSHFLTEAGIHVFILGCFSAGLPKTEANWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSSGGGSGGGGSGGGGSGGGGSGGGSLQITCPPPMSVEHADIWVKSYSLYSRERYICNSGFKRKAGTSSLTECVLNKATNVAHWTTPSLKCIRDPALVHQRPAPPSTVTTAGVTPQPESLSPSGKEPAASSPSSNNTAATTAAIVPGSQLMPSKSPSTGTTEISSHESSHGTPSQTTAKNWELTASASHQPPGVYPQGHSDTTVAISTSTVLLCGLSAVSLLACYLKSRQTPPLASVEMEAMEALPVTWGTSSRDEDLENCSHHL

SEQ ID NO: 1242 - protein, 133 aa, Artificial Sequence
  Description of Artificial Sequence: Synthetic polypeptide
GIHVFILGCFSAGLPKTEANWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 1243 - protein, 26 aa, Artificial Sequence
  Description of Artificial Sequence: Synthetic peptide
SGGGSGGGGSGGGGSGGGGSGGGSLQ

SEQ ID NO: 1244 - protein, 212 aa, Artificial Sequence
  Description of Artificial Sequence: Synthetic polypeptide
PGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERRAEVPTAHPSPSPRPAGQFQTLVVGVVGGLLGSLVLLVWVLAVIRSKRSRLLHSDYMNMTPRRPGPTRKHYQPYAPPRDFAAYRS

SEQ ID NO: 1245 - protein, 162 aa, Artificial Sequence
  Description of Artificial Sequence: Synthetic polypeptide
MRISKPHLRSISIQCYLCLLLNSHFLTEAGIHVFILGCFSAGLPKTEANWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 1246 - protein, 245 aa, Artificial Sequence
  Description of Artificial Sequence: Synthetic polypeptide
QVQLVESGGGVVQPGKSLRLSCAASGFTFSNYGIHWVRQAPGKGLEWVAVIWYDGSYKYYADSVKGRFTISRDNSKNTLYLQMNSLRAEDTALYYCARDTVDTYGSFDYWGQGTLVTVSSGSTSGSGKPGSGEGSTKGDIQLTQSPSFLSASVGDRVTITGRASQGISSYLAWYQQKPGKAPNLLIYAASTLQSGVPSRFSGSGSGTEFTLTISSLQPEDFATYYCQQHNRYPITFGQGTRLEIK

SEQ ID NO: 1247 - protein, 245 aa, Artificial Sequence
  Description of Artificial Sequence: Synthetic polypeptide
DIQLTQSPSFLSASVGDRVTITGRASQGISSYLAWYQQKPGKAPNLLIYAASTLQSGVPSRFSGSGSGTEFTLTISSLQPEDFATYYCQQHNRYPITFGQGTRLEIKGSTSGSGKPGSGEGSTKGQVQLVESGGGVVQPGKSLRLSCAASGFTFSNYGIHWVRQAPGKGLEWVAVIWYDGSYKYYADSVKGRFTISRDNSKNTLYLQMNSLRAEDTALYYCARDTVDTYGSFDYWGQGTLVTVSS

SEQ ID NO: 1248 - protein, 121 aa, Artificial Sequence
  Description of Artificial Sequence: Synthetic polypeptide
EVQLVESGGGVVRPGGSLRLSCAASGFTFDDYGVSWVRQAPGRGLEWVSGINWNGGSTAYADSVKGRFTISRDSAKNSLYLQMDSLRAEDTALYYCAREEGSYYVWYFDIWGRGTLVTVSS

SEQ ID NO: 1249 - protein, 107 aa, Artificial Sequence
  Description of Artificial Sequence: Synthetic polypeptide
DIQMTQSPSSLSASVGDRVTITCRPSQSISNYLNWYQQKPGKAPKVLIYASFILQSGVPSRFGGSGSGTDFTLTISSLQPEDFATYYCQQSYSNPFTFGPGTKVDIK

SEQ ID NO: 1250 - protein, 120 aa, Artificial Sequence
  Description of Artificial Sequence: Synthetic polypeptide
QVQLVESGGGVVQPGRSLRLSCAASGFTFSNYGMYWVRQAPGKGLEWVAVIWYDGSKKYYGDSVKGRFTISRDNSKNTLYLQMNSLRAEDTAVYYCARDEDTVMASFDYWGQGTLVTVSS

SEQ ID NO: 1251 - protein, 107 aa, Artificial Sequence
  Description of Artificial Sequence: Synthetic polypeptide
DIQLTQSPSFLSASVGDRVTITCRASQDISIYLAWYQQKPGKAPQLLIYAASTLQSGVPSRFSGSGSGTEFTLTISSLQPEDFATYSCQQLNSYPITFGGGTKVEIK

SEQ ID NO: 1252 - protein, 120 aa, Artificial Sequence
  Description of Artificial Sequence: Synthetic polypeptide
QVQLVESGGGVVQPGKSLRLSCAASGFTFSNYGIHWVRQAPGKGLEWVAVIWYDGSYKYYADSVKGRFTISRDNSKNTLYLQMNSLRAEDTALYYCARDTVDTYGSFDYWGQGTLVTVSS

SEQ ID NO: 1253 - protein, 107 aa, Artificial Sequence
  Description of Artificial Sequence: Synthetic polypeptide
DIQLTQSPSFLSASVGDRVTITGRASQGISSYLAWYQQKPGKAPNLLIYAASTLQSGVPSRFSGSGSGTEFTLTISSLQPEDFATYYCQQHNRYPITFGQGTRLEIK

SEQ ID NO: 1254 - protein, 251 aa, Artificial Sequence
  Description of Artificial Sequence: Synthetic polypeptide
PGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERRAEVPTAHPSPSPRPAGQFQTLVVGVVGGLLGSLVLLVWVLAVIRSKRSRLLHSDYMNMTPRRPGPTRKHYQPYAPPRDFAAYRSKSRQTPPLASVEMEAMEALPVTWGTSSRDEDLENCSHHL

SEQ ID NO: 1255 - protein, 24 aa, Artificial Sequence
  Description of Artificial Sequence: Synthetic peptide
DYKDDDDKDYKDDDDKDYKDDDDK

SEQ ID NO: 1256 - protein, 20 aa, Artificial Sequence
  Description of Artificial Sequence: Synthetic peptide
MQIPQAPWPVVWAVLQLGWR

SEQ ID NO: 1257 - protein, 14 aa, Artificial Sequence
  Description of Artificial Sequence: Synthetic peptide
PGWFLDSPDRPWNP

SEQ ID NO: 1258 - protein, 111 aa, Artificial Sequence
  Description of Artificial Sequence: Synthetic polypeptide
PTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVT

SEQ ID NO: 1259 - protein, 25 aa, Artificial Sequence
  Description of Artificial Sequence: Synthetic peptide
ERRAEVPTAHPSPSPRPAGQFQTLV

SEQ ID NO: 1260 - protein, 41 aa, Artificial Sequence
  Description of Artificial Sequence: Synthetic polypeptide
RSKRSRLLHSDYMNMTPRRPGPTRKHYQPYAPPRDFAAYRS

SEQ ID NO: 1261 - protein, 21 aa, Artificial Sequence
  Description of Artificial Sequence: Synthetic peptide
GSGATNFSLLKQAGDVEENPG

SEQ ID NO: 1262 - protein, 271 aa, Artificial Sequence
  Description of Artificial Sequence: Synthetic polypeptide
MQIPQAPWPVVWAVLQLGWRPGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERRAEVPTAHPSPSPRPAGQFQTLVVGVVGGLLGSLVLLVWVLAVIRSKRSRLLHSDYMNMTPRRPGPTRKHYQPYAPPRDFAAYRSKSRQTPPLASVEMEAMEALPVTWGTSSRDEDLENCSHHL

SEQ ID NO: 1263 - protein, 21 aa, Artificial Sequence
  Description of Artificial Sequence: Synthetic peptide
VGVVGGLLGSLVLLVWVLAVI

SEQ ID NO: 1264 - protein, 727 aa, Artificial Sequence
  Description of Artificial Sequence: Synthetic polypeptide
MLLLVTSLLLCELPHPAFLLIPQSALTQPRSVSGSPGQSVTISCTGTSSDVGGYNYVSWYQQHPGKAPKLMIYDVTNRPSGVPDRFSASKSDNTATLTVSGVQAEDEADYYCSSYAGSHELFGGGTKLTVLGSTSGSGKPGSGEGSTKGEVQLVQSGAEVKKPGESLKISCKGSGYSFTSYWIGWVRQMPGKGLEWMGIIYPGDSDTRYSPSFQGQVTISADKSISTAYLQWSSLKASDTAMYYCAISRTESYVMDVWGQGTTVTVSSAAAGGGGSGGGGSGGGGSLEDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRIGSGEGRGSLLTCGDVEENPGPGMQIPQAPWPVVWAVLQLGWRPGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERRAEVPTAHPSPSPRPAGQFQTLVVGVVGGLLGSLVLLVWVLAVIRSKRSRLLHSDYMNMTPRRPGPTRKHYQPYAPPRDFAAYRS

SEQ ID NO: 1265 - protein, 160 aa, Homo sapiens
QSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRN

SEQ ID NO: 1266 - protein, 151 aa, Homo sapiens
FKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKS

SEQ ID NO: 1267 - protein, 137 aa, Mus sp.
  MOD_RES (1)..(1): Any amino acid
XIQNPEPAVYQLKDPRSQDSTLCLFTDFDSQINVPKTMESGTFITDKTVLDMKAMDSKSNGAIAWSNQTSFTCQDIFKETNATYPSSDVPCDATLTEKSFETDMNLNFQNLSVMGLRILLLKVAGFNLLMTLRLWSS

SEQ ID NO: 1268 - protein, 173 aa, Mus sp.
EDLRNVTPPKVSLFEPSKAEIANKQKATLVCLARGFFPDHVELSWWVNGKEVHSGVSTDPQAYKESNYSYCLSSRLRVSATFWHNPRNHFRCQVQFHGLSEEDKWPEGSPKPVTQNISAEAWGRADCGITSASYQQGVLSATILYEILLGKATLYAVLVSTLVVMAMVKRKNS

SEQ ID NO: 1269 - protein, 295 aa, Unknown
  Description of Unknown: TCR-gamma-9G115 sequence
AGHLEQPQISSTKTLSKTARLECVVSGITISATSVYWYRERPGEVIQFLVSISYDGTVRKESGIPSGKFEVDRIPETSTSTLTIHNVEKQDIATYYCALWEAQQELGKKIKVFGPGTKLIITDKQLDADVSPKPTIFLPSIAETKLQKAGTYLCLLEKFFPDVIKIHWEEKKSNTILGSQEGNTMKTNDTYMKFSWLTVPEKSLDKEHRCIVRHENNKNGVDQEIIFPPIKTDVITMDPKDNCSKDANDTLLLQLTNTSAYYMYLLLLLKSVVYFAIITCCLLRRTAFCCNGEKS

SEQ ID NO: 1270 - protein, 290 aa, Unknown
  Description of Unknown: TCR-delta-2cl5 sequence
MQRISSLIHLSLFWAGVMSAIELVPEHQTVPVSIGVPATLRCSMKGEAIGNYYINWYRKTQGNTMTFIYREKDIYGPGFKDNFQGDIDIAKNLAVLKILAPSERDEGSYYCACDALKRTDTDKLIFGKGTRVTVEPRSQPHTKPSVFVMKNGTNVACLVKEFYPKDIRINLVSSKKITEFDPAIVISPSGKYNAVKLGKYEDSNSVTCSVQHDNKTVHSTDFEVKTDSTDHVKPKETENTKQPSKSCHKPKAIVHTEKVNMMSLTVLGLRMLFAKTVAVNFLLTAKLFFL

SEQ ID NO: 1271 - protein, 22 aa, Artificial Sequence
  Description of Artificial Sequence: Synthetic peptide
GSGEGRGSLLTCGDVEENPGPG

SEQ ID NO: 1272 - protein, 29 aa, Artificial Sequence
  Description of Artificial Sequence: Synthetic peptide
MRISKPHLRSISIQCYLCLLLNSHFLTEA

SEQ ID NO: 1273 - protein, 267 aa, Artificial Sequence
  Description of Artificial Sequence: Synthetic polypeptide
MAPRRARGCRTLGLPALLLLLLLRPPATRGITCPPPMSVEHADIWVKSYSLYSRERYICNSGFKRKAGTSSLTECVLNKATNVAHWTTPSLKCIRDPALVHQRPAPPSTVTTAGVTPQPESLSPSGKEPAASSPSSNNTAATTAAIVPGSQLMPSKSPSTGTTEISSHESSHGTPSQTTAKNWELTASASHQPPGVYPQGHSDTTVAISTSTVLLCGLSAVSLLACYLKSRQTPPLASVEMEAMEALPVTWGTSSRDEDLENCSHHL

SEQ ID NO: 1274 - protein, 39 aa, Artificial Sequence
  Description of Artificial Sequence: Synthetic polypeptide
KSRQTPPLASVEMEAMEALPVTWGTSSRDEDLENCSHHL

SEQ ID NO: 1275 - protein, 175 aa, Artificial Sequence
  Description of Artificial Sequence: Synthetic polypeptide
ITCPPPMSVEHADIWVKSYSLYSRERYICNSGFKRKAGTSSLTECVLNKATNVAHWTTPSLKCIRDPALVHQRPAPPSTVTTAGVTPQPESLSPSGKEPAASSPSSNNTAATTAAIVPGSQLMPSKSPSTGTTEISSHESSHGTPSQTTAKNWELTASASHQPPGVYPQGHSDTT

SEQ ID NO: 1276 - protein, 65 aa, Artificial Sequence
  Description of Artificial Sequence: Synthetic polypeptide
ITCPPPMSVEHADIWVKSYSLYSRERYICNSGFKRKAGTSSLTECVLNKATNVAHWTTPSLKCIR

SEQ ID NO: 1277 - protein, 172 aa, Artificial Sequence
  Description of Artificial Sequence: Synthetic polypeptide
DPALVHQRPAPPSTVTTAGVTPQPESLSPSGKEPAASSPSSNNTAATTAAIVPGSQLMPSKSPSTGTTEISSHESSHGTPSQTTAKNWELTASASHQPPGVYPQGHSDTTVAISTSTVLLCGLSAVSLLACYLKSRQTPPLASVEMEAMEALPVTWGTSSRDEDLENCSHHL

SEQ ID NO: 1278 - protein, 23 aa, Artificial Sequence
  Description of Artificial Sequence: Synthetic peptide
VAISTSTVLLCGLSAVSLLACYL

SEQ ID NO: 1279 - protein, 396 aa, Artificial Sequence
  Description of Artificial Sequence: Synthetic polypeptide
GIHVFILGCFSAGLPKTEANWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSSGGGSGGGGSGGGGSGGGGSGGGSLQITCPPPMSVEHADIWVKSYSLYSRERYICNSGFKRKAGTSSLTECVLNKATNVAHWTTPSLKCIRDPALVHQRPAPPSTVTTAGVTPQPESLSPSGKEPAASSPSSNNTAATTAAIVPGSQLMPSKSPSTGTTEISSHESSHGTPSQTTAKNWELTASASHQPPGVYPQGHSDTTVAISTSTVLLCGLSAVSLLACYLKSRQTPPLASVEMEAMEALPVTWGTSSRDEDLENCSHHL

SEQ ID NO: 1280 - protein, 9 aa, Artificial Sequence
  Description of Artificial Sequence: Synthetic peptide
  MOD_RES (1)..(1): S or G
  MOD_RES (2)..(2): I or T
  MOD_RES (4)..(4): D or G
  MOD_RES (6)..(6): V or A
  MOD_RES (9)..(9): S or N
XXFXIXRGX

SEQ ID NO: 1281 - protein, 12 aa, Artificial Sequence
  Description of Artificial Sequence: Synthetic peptide
  MOD_RES (5)..(5): S or T
  MOD_RES (6)..(6): F, V, or L
  MOD_RES (7)..(7): R or S
  MOD_RES (10)..(10): N or H
CNMEXXXYRXYW

SEQ ID NO: 1282 - protein, 9 aa, Artificial Sequence
  Description of Artificial Sequence: Synthetic peptide
  MOD_RES (1)..(1): F, L, or R
  MOD_RES (2)..(2): T, S, or N
  MOD_RES (3)..(3): L, F, or R
  MOD_RES (4)..(4): D or E
  MOD_RES (5)..(5): R, H, Y, K, N
  MOD_RES (7)..(7): S, A, or T
  MOD_RES (8)..(8): I, V, or M
  MOD_RES (9)..(9): G or N
XXXXXYXXX

SEQ ID NO: 1283 - protein, 13 aa, Artificial Sequence
  Description of Artificial Sequence: Synthetic peptide
  MOD_RES (1)..(1): S, A, T, or L
  MOD_RES (3)..(3): I or V
  MOD_RES (4)..(4): S or T
  MOD_RES (6)..(6): S, K, or N
  MOD_RES (7)..(7): G or S
  MOD_RES (8)..(8): G or D
  MOD_RES (9)..(9): I, L, or V
  MOD_RES (10)..(10): P, T, I, or V
XCXXSXXXXXKYA

SEQ ID NO: 1284 - protein, 21 aa, Artificial Sequence
  Description of Artificial Sequence: Synthetic peptide
  MOD_RES (2)..(2): G, T, or A
  MOD_RES (5)..(5): T, G, or D
  MOD_RES (7)..(7): D, P, A, or K
  MOD_RES (13)..(13): P, A, or H
  MOD_RES (15)..(15): H or Y
CXAAXPXDDCSVXGXYGLNYW

SEQ ID NO: 1285 - protein, 9 aa, Artificial Sequence
  Description of Artificial Sequence: Synthetic peptide
  MOD_RES (1)..(1): F or H
XTFDAYAIG

SEQ ID NO: 1286 - protein, 16 aa, Artificial Sequence
  Description of Artificial Sequence: Synthetic peptide
  MOD_RES (3)..(3): T or A
CAXPSWCSLKADFGSW

SEQ ID NO: 1287 - protein, 12 aa, Artificial Sequence
  Description of Artificial Sequence: Synthetic peptide
  MOD_RES (5)..(5): T or I
  MOD_RES (9)..(9): A or G
AIINXGGSXNVD

SEQ ID NO: 1288 - protein, 9 aa, Artificial Sequence
  Description of Artificial Sequence: Synthetic peptide
  MOD_RES (7)..(7): D or G
CNVYYRXLW

SEQ ID NO: 1289 - protein, 12 aa, Artificial Sequence
  Description of Artificial Sequence: Synthetic peptide
  MOD_RES (3)..(3): I or V
  MOD_RES (7)..(7): G or D
  MOD_RES (10)..(10): N or D
AIXTSGXATXYA

SEQ ID NO: 1290 - protein, 50 aa, Artificial Sequence
  Description of Artificial Sequence: Synthetic polypeptide
  SITE (1)..(50): This sequence may encompass 1-10 "Gly Gly Gly Gly Ser" repeating units
  See specification as filed for detailed description of substitutions and preferred embodiments
GGGGSGGGGSGGGGSGGGGSGGGGSGGGGSGGGGSGGGGSGGGGSGGGGS

SEQ ID NO: 1291 - protein, 4 aa, Artificial Sequence
  Description of Artificial Sequence: Synthetic peptide
  See specification as filed for detailed description of substitutions and preferred embodiments
GGGS

SEQ ID NO: 1292 - protein, 20 aa, Artificial Sequence
  Description of Artificial Sequence: Synthetic peptide
GGGGSGGGGSGGGGSGGGGS

SEQ ID NO: 1293 - protein, 15 aa, Artificial Sequence
  Description of Artificial Sequence: Synthetic peptide
GGGGSGGGGSGGGGS

SEQ ID NO: 1294 - protein, 20 aa, Artificial Sequence
  Description of Artificial Sequence: Synthetic peptide
  SITE (1)..(20): This sequence may encompass 2-4 "Gly Gly Gly Gly Ser" repeating units
GGGGSGGGGSGGGGSGGGGS

SEQ ID NO: 1295 - protein, 15 aa, Artificial Sequence
  Description of Artificial Sequence: Synthetic peptide
  SITE (1)..(15): This sequence may encompass 1-3 "Gly Gly Gly Gly Ser" repeating units
GGGGSGGGGSGGGGS

SEQ ID NO: 1296 - RNA, 5000 nt, Artificial Sequence
  Description of Artificial Sequence: Synthetic polynucleotide
  misc_feature (1)..(5000): This sequence may encompass 50-5000 nucleotides
  See specification as filed for detailed description of substitutions and preferred embodiments
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 1297 - protein, 30 aa, Artificial Sequence
  Description of Artificial Sequence: Synthetic polypeptide
  SITE (1)..(30): This sequence may encompass 1-6 "Gly Gly Gly Gly Ser" repeating units
  See specification as filed for detailed description of substitutions and preferred embodiments
GGGGSGGGGSGGGGSGGGGSGGGGSGGGGS

SEQ ID NO: 1298 - protein, 5 aa, Artificial Sequence
  Description of Artificial Sequence: Synthetic peptide
  See specification as filed for detailed description of substitutions and preferred embodiments
GGGGS

SEQ ID NO: 1299 - protein, 9 aa, Artificial Sequence
  Description of Artificial Sequence: Synthetic peptide
  MOD_RES (1)..(1): Any naturally occurring amino acid
  MOD_RES (2)..(2): Any naturally occurring amino acid
  MOD_RES (4)..(4): Any naturally occurring amino acid
  MOD_RES (6)..(6): Any naturally occurring amino acid
  MOD_RES (9)..(9): Any naturally occurring amino acid
XXFXIXRGX

SEQ ID NO: 1300 - protein, 12 aa, Artificial Sequence
  Description of Artificial Sequence: Synthetic peptide
  MOD_RES (3)..(3): Any naturally occurring amino acid
  MOD_RES (7)..(7): Any naturally occurring amino acid
  MOD_RES (10)..(10): Any naturally occurring amino acid
AIXTSGXATXYA

SEQ ID NO: 1301 - protein, 12 aa, Artificial Sequence
  Description of Artificial Sequence: Synthetic peptide
  MOD_RES (5)..(5): Any naturally occurring amino acid
  MOD_RES (6)..(6): Any naturally occurring amino acid
  MOD_RES (7)..(7): Any naturally occurring amino acid
  MOD_RES (10)..(10): Any naturally occurring amino acid
CNMEXXXYRXYW

SEQ ID NO: 1302 - protein, 9 aa, Artificial Sequence
  Description of Artificial Sequence: Synthetic peptide
  MOD_RES (1)..(1): Any naturally occurring amino acid
  MOD_RES (2)..(2): Any naturally occurring amino acid
  MOD_RES (3)..(3): Any naturally occurring amino acid
  MOD_RES (4)..(4): Any naturally occurring amino acid
  MOD_RES (5)..(5): Any naturally occurring amino acid
  MOD_RES (7)..(7): Any naturally occurring amino acid
  MOD_RES (8)..(8): Any naturally occurring amino acid
  MOD_RES (9)..(9): Any naturally occurring amino acid
XXXXXYXXX

SEQ ID NO: 1303 - protein, 13 aa, Artificial Sequence
  Description of Artificial Sequence: Synthetic peptide
  MOD_RES (1)..(1): Any naturally occurring amino acid
  MOD_RES (3)..(3): Any naturally occurring amino acid
  MOD_RES (4)..(4): Any naturally occurring amino acid
  MOD_RES (6)..(6): Any naturally occurring amino acid
  MOD_RES (7)..(7): Any naturally occurring amino acid
  MOD_RES (8)..(8): Any naturally occurring amino acid
  MOD_RES (9)..(9): Any naturally occurring amino acid
  MOD_RES (10)..(10): Any naturally occurring amino acid
XCXXSXXXXXKYA

SEQ ID NO: 1304 - protein, 21 aa, Artificial Sequence
  Description of Artificial Sequence: Synthetic peptide
  MOD_RES (2)..(2): Any naturally occurring amino acid
  MOD_RES (5)..(5): Any naturally occurring amino acid
  MOD_RES (7)..(7): Any naturally occurring amino acid
  MOD_RES (13)..(13): Any naturally occurring amino acid
  MOD_RES (15)..(15): Any naturally occurring amino acid
CXAAXPXDDCSVXGXYGLNYW

SEQ ID NO: 1305 - protein, 9 aa, Artificial Sequence
  Description of Artificial Sequence: Synthetic peptide
  MOD_RES (1)..(1): Any naturally occurring amino acid
XTFDAYAIG

SEQ ID NO: 1306 - protein, 13 aa, Artificial Sequence
  Description of Artificial Sequence: Synthetic peptide
ICLSPSDGSTYYA

SEQ ID NO: 1307 - protein, 16 aa, Artificial Sequence
  Description of Artificial Sequence: Synthetic peptide
  MOD_RES (3)..(3): Any naturally occurring amino acid
CAXPSWCSLKADFGSW

SEQ ID NO: 1308 - protein, 9 aa, Artificial Sequence
  Description of Artificial Sequence: Synthetic peptide
SIIRDNVMA

SEQ ID NO: 1309 - protein, 12 aa, Artificial Sequence
  Description of Artificial Sequence: Synthetic peptide
  MOD_RES (5)..(5): Any naturally occurring amino acid
  MOD_RES (9)..(9): Any naturally occurring amino acid
AIINXGGSXNVD

SEQ ID NO: 1310 - protein, 9 aa, Artificial Sequence
  Description of Artificial Sequence: Synthetic peptide
  MOD_RES (7)..(7): Any naturally occurring amino acid
CNVYYRXLW

SEQ ID NO: 1311 - protein, 9 aa, Artificial Sequence
  Description of Artificial Sequence: Synthetic peptide
SIFSIARMN

SEQ ID NO: 1312 - protein, 9 aa, Artificial Sequence
  Description of Artificial Sequence: Synthetic peptide
FTLDYYAIA

SEQ ID NO: 1313 - protein, 12 aa, Artificial Sequence
  Description of Artificial Sequence: Synthetic peptide
AILNRAGRTDYA

SEQ ID NO: 1314 - protein, 12 aa, Artificial Sequence
  Description of Artificial Sequence: Synthetic peptide
CNLQTISYHDFW

SEQ ID NO: 1315 - protein, 9 aa, Artificial Sequence
  Description of Artificial Sequence: Synthetic peptide
SIFSATRME

SEQ ID NO: 1316 - protein, 12 aa, Artificial Sequence
  Description of Artificial Sequence: Synthetic peptide
AIVTSGGRTNYA

SEQ ID NO: 1317 - protein, 12 aa, Artificial Sequence
  Description of Artificial Sequence: Synthetic peptide
CKFERYDYVNYW

SEQ ID NO: 1318 - RNA, 2000 nt, Artificial Sequence
  Description of Artificial Sequence: Synthetic polynucleotide
  misc_feature (1)..(2000): This sequence may encompass 50-2000 nucleotides
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 1319 - DNA, 100 bp, Artificial Sequence
  Description of Artificial Sequence: Synthetic polynucleotide
tttttttttttttttttttttttttttttttttttttttttttttttttttttttttttttttttttttttttttttttttttttttttttttttttttt

SEQ ID NO: 1320 - DNA, 5000 bp, Artificial Sequence
  Description of Artificial Sequence: Synthetic polynucleotide
  misc_feature (1)..(5000): This sequence may encompass 50-5000 nucleotides
tttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttt

SEQ ID NO: 1321 - RNA, 5000 nt, Artificial Sequence; identical to SEQ ID NO: 1296
  Description of Artificial Sequence: Synthetic polynucleotide
  misc_feature (1)..(5000): This sequence may encompass 100-5000 nucleotides

SEQ ID NO: 1322 - RNA, 400 nt, Artificial Sequence
  Description of Artificial Sequence: Synthetic polynucleotide
  misc_feature (1)..(400): This sequence may encompass 100-400 nucleotides
  See specification as filed for detailed description of substitutions and preferred embodiments
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 1323 - protein, 6 aa, Artificial Sequence
  Description of Artificial Sequence: Synthetic 6xHis tag
HHHHHH

SEQ ID NO: 1324 - protein, 11 aa, Artificial Sequence
  Description of Artificial Sequence: Synthetic peptide
HIQVTLAICSS

What is claimed is:

1. A recombinant nucleic acid molecule comprising a sequence encoding a T cell receptor (TCR) fusion protein (TFP),
   wherein the TFP comprises:
   (a) a TCR subunit comprising:
      (i) at least a portion of a TCR extracellular domain, and
      (ii) a TCR transmembrane domain,
      (iii) a TCR intracellular domain, and
   (b) an antigen binding domain that specifically binds CD70;
   wherein the TCR subunit and the antigen binding domain are operatively linked;
   wherein the TFP functionally interacts with an endogenous TCR complex when expressed in a T cell; and
   wherein the recombinant nucleic acid molecule comprises a sequence encoding an amino acid sequence having at least 90%, 95%, 98%, 99% or more sequence identity to any one of the amino acid sequences selected from the group consisting of SEQ ID NOs: 1233, 1236, 1240, and 1264.

2. The recombinant nucleic acid molecule of claim 1, wherein at least two of the TCR extracellular domain, the TCR transmembrane domain, and the TCR intracellular domain are from the same TCR subunit, or wherein all three of the TCR extracellular domain, the TCR transmembrane domain, and the TCR intracellular domain are from the same TCR subunit.

3. The recombinant nucleic acid molecule of claim 2, wherein at least two of the TCR extracellular domain, the TCR transmembrane domain, and the TCR intracellular domain are from TCR alpha, TCR beta, TCR gamma, TCR delta, CD3 epsilon, CD3 delta, or CD3 gamma, or wherein all three of the TCR extracellular domain, the TCR transmembrane domain, and the TCR intracellular domain are from CD3 epsilon, CD3 delta, or CD3 gamma.

4. The recombinant nucleic acid molecule of claim 1, wherein the TCR intracellular domain comprises a stimulatory domain from an intracellular signaling domain of CD3 gamma, CD3 delta, or CD3 epsilon.

5. The recombinant nucleic acid molecule of claim 1, wherein the antigen binding domain is connected to the TCR extracellular domain by a linker sequence.

6. The recombinant nucleic acid molecule of claim 5, wherein the linker sequence comprises (G4S)n, wherein G is glycine, S is serine, and n is an integer from 1 to 10.

7. The recombinant nucleic acid molecule of claim 1, wherein the antigen binding domain is a single-chain variable fragment (scFv) or a single domain antibody (sdAb) domain.

8. The recombinant nucleic acid molecule of claim 7, wherein the sdAb is a VHH.

9. The recombinant nucleic acid molecule of claim 1, wherein:
   (a) a T cell expressing the TFP exhibits increased cytotoxicity to a human cell expressing CD70 compared to a T cell not containing the TFP;
   (b) a T cell expressing the TFP inhibits tumor growth when expressed in a T cell;
   (c) a T cell expressing the TFP has increased fratricide relative to a TFP having a different antigen binding domain, or a T cell expressing the TFP has decreased fratricide relative to a TFP having a different antigen binding domain; or
   (d) any combination thereof.

10. The recombinant nucleic acid molecule of claim 1, further comprising a promoter, a leader sequence, a sequence encoding a poly (A) tail, a 3'UTR sequence, or any combination thereof.

11. The recombinant nucleic acid molecule of claim 1, wherein the recombinant nucleic acid molecule further comprises a second sequence encoding an interleukin-15 (IL-15) polypeptide or a fragment thereof.

12. The recombinant nucleic acid molecule of claim 11, wherein the second sequence encodes a fusion protein comprising the IL-15 polypeptide linked to a IL-15Rα subunit.

13. The recombinant nucleic acid molecule of claim 12, wherein the fusion protein comprises amino acids 31-267 of IL-15Rα or a IL-15Rα sushi domain.

14. The recombinant nucleic acid molecule of claim 12, wherein the fusion protein is expressed on cell surface or secreted when expressed in a cell.

15. The recombinant nucleic acid molecule of claim 11, wherein the sequence encoding the TFP and the second sequence are included in a single nucleic acid molecule, and the sequence encoding the TFP and the second sequence are operatively linked by a second linker comprising a protease cleavage site.

16. A recombinant nucleic acid molecule comprising a sequence encoding a T cell receptor (TCR) fusion protein (TFP), wherein the TFP comprises:

(a) a TCR subunit comprising:

(i) at least a portion of a TCR extracellular domain, and (ii) a TCR transmembrane domain, (iii) a TCR intracellular domain, and (b) an antigen binding domain that specifically binds CD70;

wherein the TCR subunit and the antigen binding domain are operatively linked;

wherein the TFP functionally interacts with an endogenous TCR complex when expressed in a T cell, wherein the antigen binding domain is an scFv comprising a sequence having at least 90% sequence identity to residues 23-268 of SEQ ID NO:1236.

17. The recombinant nucleic acid molecule of claim 1, wherein the antigen binding domain is a scFv comprising:

(i) a VH domain comprising a sequence having at least 90%, 95%, or 100% sequence identity to SEQ ID NO: 1248, and a VL domain comprising a sequence having at least 90%, 95%, or 100% sequence identity to SEQ ID NO: 1249;

(ii) a VH domain comprising a sequence having at least 90%, 95%, or 100% sequence identity to SEQ ID NO: 1250, and a VL domain comprising a sequence having at least 90%, 95%, or 100% sequence identity to SEQ ID NO: 1251;

(iii) a VH domain comprising a sequence having at least 90%, 95%, or 100% sequence identity to SEQ ID NO: 1252, and a VL domain comprising a sequence having at least 90%, 95%, or 100% sequence identity to SEQ ID NO: 1253; or (iv) a VH domain comprising a sequence having at least 90%, 95%, or 100% sequence identity to SEQ ID NO: 800, and a VL domain comprising a sequence having at least 90%, 95%, or 100% sequence identity to SEQ ID NO: 1012.

18. The recombinant nucleic acid molecule of claim 17, wherein the scFv comprises a linker sequence of SEQ ID NO: 1237 or a linker sequence of SEQ ID NO: 782.

19. The recombinant nucleic acid molecule of claim 1, wherein the antigen binding domain is a scFv comprising a VH domain and a VL domain comprising the sequences of SEQ ID NOs: 1248 and 1249, respectively; the sequences of SEQ ID NOs: 1250 and 1251, respectively; or the sequences of SEQ ID NOs: 1252 and 1253, respectively; and wherein the VH domain and the VL domain are operably linked via a linker sequence of SEQ ID NO: 1237.

20. The recombinant nucleic acid molecule of claim 17, wherein:

(i) a VH domain of the sequence of SEQ ID NO: 1248 operably linked via its C-terminus to the N-terminus of the VL domain of the sequence of SEQ ID NO: 1249;

(ii) a VL domain of the sequence of SEQ ID NO: 1249 operably linked via its C-terminus to the N-terminus of the VH domain of the sequence of SEQ ID NO: 1248;

(iii) a VH domain of the sequence of SEQ ID NO: 1250 operably linked via its C-terminus to the N-terminus of the VL domain of the sequence of SEQ ID NO: 1251;

(iv) a VL domain of the sequence of SEQ ID NO: 1251 operably linked via its C-terminus to the N-terminus of the VH domain of the sequence of SEQ ID NO: 1250;

(v) a VH domain of the sequence of SEQ ID NO: 1252 operably linked via its C-terminus to the N-terminus of the VL domain of the sequence of SEQ ID NO: 1253;

(vi) a VL domain of the sequence of SEQ ID NO: 1253 operably linked via its C-terminus to the N-terminus of the VH domain of the sequence of SEQ ID NO: 1252;

(vii) a VH domain of the sequence of SEQ ID NO: 800 operably linked via its C-terminus to the N-terminus of the VL domain of the sequence of SEQ ID NO: 1012; or (viii) a VL domain of the sequence of SEQ ID NO: 1012 operably linked via its C-terminus to the N-terminus of the VH domain of the sequence of SEQ ID NO: 800.

21. A cell comprising the recombinant nucleic acid molecule of claim 1.

22. The cell of claim 21, wherein:

(i) the cell is a T cell;

(ii) the cell comprises a functional disruption of an endogenous CD70 gene or a functional disruption of an endogenous CIITA gene; or (iii) a combination thereof.

23. A method of treating cancer in a subject in need thereof comprising:

administering a pharmaceutical composition comprising a therapeutically effective amount of the cell of claim 21 to the subject, thereby treating the cancer in the subject.

24. An antibody or a fragment thereof comprising an antigen binding domain that specifically binds CD70, wherein:

the antigen binding domain is a single-chain variable fragment (scFv) comprising a sequence having at least 90% sequence identity to residues 23-268 of SEQ ID NO: 1236.

25. The recombinant nucleic acid molecule of claim 16, wherein at least two of the TCR extracellular domain, the TCR transmembrane domain, and the TCR intracellular domain are from the same TCR subunit, or wherein all three of the TCR extracellular domain, the TCR transmembrane domain, and the TCR intracellular domain are from the same TCR subunit.

26. The recombinant nucleic acid molecule of claim 16, wherein at least two of the TCR extracellular domain, the TCR transmembrane domain, and the TCR intracellular domain are from TCR alpha, TCR beta, TCR gamma, TCR delta, CD3 epsilon, CD3 delta, or CD3 gamma, or wherein all three of the TCR extracellular domain, the TCR transmembrane domain, and the TCR intracellular domain are from CD3 epsilon, CD3 delta, or CD3 gamma.

27. The recombinant nucleic acid molecule of claim 16, wherein the TCR intracellular domain comprises a stimulatory domain from an intracellular signaling domain of CD3 gamma, CD3 delta, or CD3 epsilon.

28. The recombinant nucleic acid molecule of claim 16, wherein the antigen binding domain is connected to the TCR extracellular domain by a linker sequence.

29. The recombinant nucleic acid molecule of claim 28, wherein the linker sequence comprises (G4S) n, wherein G is glycine, S is serine, and n is an integer from 1 to 10.

30. The recombinant nucleic acid molecule of claim 16, wherein:

(a) a T cell expressing the TFP exhibits increased cytotoxicity to a human cell expressing CD70 compared to a T cell not containing the TFP;

(b) a T cell expressing the TFP inhibits tumor growth when expressed in a T cell;

(c) a T cell expressing the TFP has increased fratricide relative to a TFP having a different antigen binding domain, or a T cell expressing the TFP has decreased fratricide relative to a TFP having a different antigen binding domain; or (d) any combination thereof.

31. The recombinant nucleic acid molecule of claim 16, further comprising a promoter, a leader sequence, a sequence encoding a poly (A) tail, a 3'UTR sequence, or any combination thereof.

32. The recombinant nucleic acid molecule of claim 16, wherein the recombinant nucleic acid molecule further comprises a second sequence encoding an interleukin-15 (IL-15) polypeptide or a fragment thereof.

33. The recombinant nucleic acid molecule of claim 32, wherein the second sequence encodes a fusion protein comprising the IL-15 polypeptide linked to a IL-15Rα subunit.

34. The recombinant nucleic acid molecule of claim 33, wherein the fusion protein comprises amino acids 31-267 of IL-15Rα or a IL-15Rα sushi domain.

35. The recombinant nucleic acid molecule of claim 33, wherein the fusion protein is expressed on cell surface or secreted when expressed in a cell.

36. The recombinant nucleic acid molecule of claim 32, wherein the sequence encoding the TFP and the second sequence are included in a single nucleic acid molecule, and the sequence encoding the TFP and the second sequence are operatively linked by a second linker comprising a protease cleavage site.

37. A cell comprising the recombinant nucleic acid molecule of claim 16.

38. The cell of claim 16, wherein:

(i) the cell is a T cell;

(ii) the cell comprises a functional disruption of an endogenous CD70 gene or a functional disruption of an endogenous CIITA gene; or (iii) a combination thereof.

39. The recombinant nucleic acid molecule of claim 16, wherein the antigen binding domain comprises:

a heavy chain variable region (VH) comprising:

a complementarity determining region 1 (CDRH1) comprising an amino acid sequence as set forth in SEQ ID NO: 853, a CDRH2 comprising an amino acid sequence as set forth in SEQ ID NO: 906, and a CDRH3 comprising an amino acid sequence as set forth in SEQ ID NO: 959; and a light chain variable region (VL) comprising:

a complementarity determining region 1 (CDRL1) comprising an amino acid sequence as set forth in SEQ ID NO: 1065, a CDRL2 comprising an amino acid sequence as set forth in SEQ ID NO: 1118, and a CDRL3 comprising an amino acid sequence as set forth in SEQ ID NO: 1171.

40. The antibody or the fragment thereof of claim 24, wherein the antigen binding domain comprises:

a heavy chain variable region (VH) comprising:

a complementarity determining region 1 (CDRH1) comprising an amino acid sequence as set forth in SEQ ID NO: 853, a CDRH2 comprising an amino acid sequence as set forth in SEQ ID NO: 906, and a CDRH3 comprising an amino acid sequence as set forth in SEQ ID NO: 959; and a light chain variable region (VL) comprising:

a complementarity determining region 1 (CDRL1) comprising an amino acid sequence as set forth in SEQ ID NO: 1065, a CDRL2 comprising an amino acid sequence as set forth in SEQ ID NO: 1118, and a CDRL3 comprising an amino acid sequence as set forth in SEQ ID NO: 1171.

* * * * *